United States Patent 7,745,391 (HUMAN THROMBOSPONDIN POLYPEPTIDE) - sequence listing, part 154

SEQ ID NO: 402770 - DNA, 4100 bp, Homo sapiens
  misc_feature (342)..(342): n is a, c, g, or t
tgtccatccccccttcgtgacaagaataaaatgcaaagagccaactctgttactgtagatggacaaggcctgcaggtcactcctgtgcctggtactcacccacttttagtttttgtgaaccccacaaagtggtggaaaacaaggagaacgacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccgnactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaatagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcaagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctata

SEQ ID NO: 402771 - DNA, 4158 bp, Homo sapiens
  misc_feature (342)..(342): n is a, c, g, or t
tgtccatccccccttcgtgacaagaataaaatgcaaagagccaactctgttactgtagatggacaaggcctgcaggtcactcctgtgcctggtactcacccacttttagtttttgtgaaccccacaaagtggtggaaaacaaggagaacgacaatagattttgaaggtttcaaactattcatgaagacattcctggaagccgagcttcctgatgatttcactgcacaccttttcatgtcatttagcaacaagtttcctcattctagtccaatggtaaaaagtaagcctgctctcctatcaggcggtctgagaatgaataaaggtgccatcacccctccccgnactacttctcctgcaaatacgtgttccccagaagtaatccatctgaaggacattgtctgttacctgtctctgcttgaaagaggaagacctgaggataagcttgagtttatgtttcgcctttatgacacggatgggaatggcttcctggacagctcggagctagaaaatatcatcagtcagatgatgcatgttgcagaataccttgagtgggatgtcactgaacttaatccaatcctccatgaaatgatggaagaaattgactatgatcatgatggaaccgtgtctctggaggaatggattcaaggaggaatgacaacgattccacttcttgtgctcctgggcttagaaaataacgtgaaggatgatggacagcacgtgtggcgactgaagcactttaacaaacctgcctattgcaacctttgcctgaacatgctgattggcgtggggaagcagggcctctgctgttccttctgcaagtacacagtccatgagcgctgtgtggctcgagcacctccctcttgcatcaagacctatgtgaagtccaaaaggaacactgatgtcatgcaccattactgggttgaaggtaactgcccaaccaagtgtgataagtgccacaaaactgttaaatgttaccagggcctgacaggactgcattgtgtttggtgtcagatcacactgcataataaatgtgcttctcatctaaaacctgaatgtgactgtggacctttgaaggaccatattttaccacccacaacaatctgtccagtggtactgcagactctgcccacttcaggagtttcagttcctgaggaaagacaatcaacagtgaaaaaggaaaagagtggttcccagcagccaaacaaagtgattgacaagaataaaatgcaaagagccaactctgttactgtagatggacaaggcctgcaggtcactcctgtgcctggtactcacccacttttagtttttgtgaaccccaaaagtggtggaaaacaaggagaacgaatttacagaaaattccagtatctattaaatcctcgtcaggtttacagtctttctggaaatggaccaatgccagggttaaactttttccgtgatgttcctgacttcagagtgttagcctgtggtggagatggaaccgtgggctgggttttggattgcatagaaaaggccaatgtaggcaagcatcctccagttgcgattctgcctcttgggactggcaatgatctagcaagatgcctgcgatggggaggaggttacgaaggtgagaatctgatgaaaattctaaaagacattgaaaacagcacagaaatcatgttggacaggtggaagtttgaagtcatacctaatgacaaagatgagaaaggagacccagtgccttacagtatcatcaataattacttttccattggcgtggatgcctccattgcacacagattccacatcatgagagaaaaacacccagagaaattcaacagtagaatgaagaacaaattttggtattttgagtttggcacatctgaaactttctcagccacctgcaagaagctacatgaatctgtagaaatagaatgtgatggagtacagatagatttaataaacatctctctggaaggaattgctattttgaatataccaagcatgcatggaggatccaatctttggggagagtctaagaaaagacgaagccatcgacgaatagagaaaaaagggtctgacaaaaggaccaccgtcacagatgccaaagagttgaagtttgcaagtcaagatctcagtgaccagctgctggaggtggtcggcttggaaggagccatggagatggggcaaatatacacaggcctgaaaagtgctggccggcggctggctcagtgctcctgcgtggtcatcaggacgagcaagtctctgccaatgcaaattgatggggagccatggatgcagaccccatgcacaataaaaattacacacaagaaccaagccccaatgctgatgggcccgcctccaaaaaccggtttattctgctccctcgtcaaaaggacaagaaaccgaagcaaggaataatcctgtgttgtttcactcttagaaattgaattagcataattgggccatggaacacatatgctggaaatctttgaaccatttcaagtctcctgctcatgcaaaatcatggaagtggtttaacagtttttgttactaagctaatgtaaaattcagctattagaaaatttattgtctcagtttttataggcatctttgcatgaagaaagcagaagtttacctgaagtgatactgcatatttttggtgcatgcattcccatagatttttacatctcccacccaactcttccccaatttccttttactaacctgtgagaaaaacccgtgaaacatgaaaaaggaaataccatgggaaacgtgattctcagtgtgattccaattattacgaagcactaatcagtaacgctacaatgatcataattgcagattgctatacgtttcccttttagaatcagtgtatcagtgacctatgacttgaggagaaacttttaattcgaagattttattaaatagttgactacaataccttgctatatatacatagtttttcttcaacatcttaactcttctgagtggaaataaaaatatcaggcataaggttttctcatgctgaaaaatagaacgcggtttttattttgcttagttttctttttaattccagaaataagtgaaaacatgttacttgacagtcaagtgtggtaatatggcaagccttgttcctttctgcatgagaatctaggagagaattcataaccacaccaataacgaaacacattgattaggcacatagtttaaaacttctatttcgttattggtgtggttatgaattagaagttttaaactatgtgcctaatcaatgtgtttcccaccaaagattcagaaaacaatgcttgagagaaatgggttaatgcataattaattaagcattgtggagcaaatttagggttcctgtgattaattttgtgatgactaaaatgctggaaagcaagtgagttgcccattaattatgattaaaattctcacctttcacagacagacaataagccagacaacacaatcaaagctcaatagatgatttcttgcttttttcagtcatttataaatataggtgtaatttttcatggatcagttaagtacacttgaaggaagtaaatgattgtatcagtttatttctagtataaatgggtacctgtaataatactgagctcttggaagcgaatcatgcatgcaattagctccctcctcctcacctactccactcccatctttatgacatttcaaatgtttatttggaaacaacagcctagatcactgttgaaggtgttcatggcatagttggagtctctgactgtttaaagaaatcacagaacagtacttttcttttagtgtttcattaagcctatgatgtaaaatgaaatgcttctgagcagtcttgtaatattgttcattcatattgacctgcatctcatcattgcatgttttatgttttcaaacatgccataaggaaaacgagtgcctgaactgcatgatttattagtttctctccactctgcattaaagtgctaatgatttatcggttctattttgttattgattcattcatctttctttgaataacaaatagcatttagtgattctgttgaacacaatcctgtgcatggatttatggatttcaagtgaaattgctataattttagttctttggtttgaaaactcaactgaatgctgttatatcaaatagctgctctcaagcaatgtgctata

SEQ ID NO: 402772 - DNA, 855 bp, Homo sapiens
ctcacagtgggcgggagcggaggcaacagctgggccaggttcatgggggctttggggtggctgggaaagttctattcttgacctgcgtggaattcaaaggtgtttgtcttatggaaacccactaagctttatattggtttatgtgcttttttctatctatgctttcttttatagtaagacagtttagaaggaaagctgtcaggaggtgagtggggactctgctgagggttacgtggaacggaaggcaagacagtggagggtgcaggagtaggggaggcaaggacaaagtggggacaggacgtgcagacttgttcaggtccccctggctgaggactcagcggagagggaaggtggcagcagggggcgctggtggtcaagggtggttctgaaggagaggaggatggaattgcttctggagggtaggaggaaggcgtaggtgctgggccttccaggaagaccagaggcccctccctaggccttgactcagcttgaaacctggggagtaaggatgcgctgtgagggcacagaaggaaagctttgtataaaccaaagaatgtgaaaaatctcaataatttaagaatactggaagtcctcgccagatcaactaggcaagaggaatagaggcatccaaattggaaaagaggaagtcaaattatccctgttcactgatgatatgattttatatctagaaaaccctgaggatgtcaccaaaaaattctgagttaataaattaattcagtaaaatttcagaatacaaaattaacatacagaaatcattagagttcctatataccaatgacgatccagccccaaatcaggaaggcaatcccatttacaatagctaccaaaaaaaaa

SEQ ID NO: 402773 - DNA, 400 bp, Homo sapiens
acacctgactcttcagctccaggtatctcacaaagggtctcgccactcttcttcactttatgctttcatcagatcagttatggggcttccaacagtgggaacagacaagggtcaccaaattacacccaacatctacttgaaaattacagatgctattaggggcatcccatggatgaccaccacatcgactgtgatgcacagttgccaacacggcttgcttctctcttgattaaggtatgtgtcaatgcaattctgtttggcagcactagaaaaactcaaggtaccctctaggttcacagtgcaggggccaacagtgtgatggctgttaaggctcagggctcatcagcgaaagggctctatagaaatgcaacatgctattatcacaacaatcatagctatt

SEQ ID NO: 402774 - DNA, 481 bp, Homo sapiens
ggtttgtttacaccagcatcatcacaaatacatgagtaatatgttatgctatgactttacaaatggctacgatatctctaggcataggaatttttcagctcctttataatcttataggactaccttcattaatgtggtctgtcgttgacccaaacattgttatgttgtgcatgactataattacaactgtgaccacccctgccagtccgtctagcctactccctatcttcactccgttatttctcaatgacccctaaatctccaatctatttatattacattaatatttctatacccacaatcccaccccccatacactcacttcctttattatttagcttatattctggagtccttcaattgtagcaagtctctggccattactaacttacttgcccttcatactgcacttacctggcaaaatgctttaccttccacatgatctctttatctcatttacattttgttttctaagatattc

SEQ ID NO: 402775 - DNA, 287 bp, Homo sapiens
aattatacaaccatcaccacaatcaactttagagcatttttaacaacctcaaagaaacttgttctcattagcacccactcccaattcctccctactcccagccaaaacaaccactcatctaccttctctctattgatctgcctattctagatatttcgtataaatgaagtcataccatatatggtcttttatgactggcttctttcacttagcataacgttttcaagggtcatccatgtagtagcatgtatggatatctcgttctttttatggctaaaatatagtcc

SEQ ID NO: 402776 - DNA, 477 bp, Homo sapiens
catctcttttgggactcattatttcctactttgacttataatcatttgtgcactattgtttatccccccctactgtactgtaacttcttggttgaagggatcttgacttatccttatttgtaattccctctagcacctgaggcaatgtagcgcacagtgagtggcctgtaaatagcttttgaatgaataatatataaaacactaacaatacaagactctatatctgatctgccaaatgcatagaactggcagcaagtgctgtagaagttcattgggattgggttgctcaggagagtttccatagaggaaggagtgtcttcaattgaaaacgtgaaaaatgaactggagaaacaagggtgggggcggtccaggcaagtggaagagtatgcagggtgtttataaggtggaaacacagaaaagttatattttatgctttagtggacactgcagatttcttggaatggtacgatttttgta

SEQ ID NO: 402777 - DNA, 1310 bp, Homo sapiens
ctcacaggagctcagagcgagaactcattcattatggcaaggacagcaccaagccattcatgaggggtccacccccatgacccaaaaacctcccattaggttcctcctccaacaacggggatcaggttttaacatgaggcttgatgtggccaaaaaaccacatccaaaccatagcagtagcccagcttctcttttcactcattgtgtttgttgccaataaactctgtagcctcaaaagatgggaacttttccttttgggtgttgtggatcccatccatgaaaccgaaagtaagtgttgagcagagcaagctgtatgtaaaggccaaggaatgaagaagcaggagtgtggctcacaaatcaacttctctactcctgaggggtgaggggattgaaatagagggtttcttgaatgaaggggttggacattgaaagcaaggggaagaatattcatggcttttctggaaatggacggtgaacttctgggagctgaagcactgccatctttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctc

SEQ ID NO: 402778 - DNA, 431 bp, Homo sapiens
gaagaagataatgttcttaaaccactcttggtgaaacaaatgcacttatcatctccccttcctacgccacttccaaacccaattctctccagtggctggtgatgctcacctggactgaatttcccagcttctgccgcaggtctgtgaggccatgtgacctgagaagcagtgaaggtggcagaagtgggatccaccacatccaagctcaggccatgaaactgcctgtggcatcctccacactcttgctcttctctctcctgctggtcagacatggatgatccagtggaggcctccaaggccctaggggatggcagaaccgctcgatagcagatgcttggggccctggaggactgcatggatcaaagccccctccaaccaaccttgattgtgaaatgatgatgaaataaaccttcattatggtgtgtcaaaga

SEQ ID NO: 402779 - DNA, 416 bp, Homo sapiens
ggtccatgggagcaggagttgtctcgctttctgctgagtcctctgcgtccccttcttgcagtcagagccccacagttgacgtgtgctcttaccgctggactgaatttcccagcttctgccgcaggtctgtgaggccatgtgacctgagaagcagtgaaggtggcagaagtgggatccaccacatccaagctcaggccatgaaactgcctgtggcatcctccacactcttgctcttctctctcctgctggtcagacatggatgatccagtggaggcctccaaggccctaggggatggcagaaccgctcgatagcagatgcttggggccctggaggactgcatggatcaaagccccctccaaccaaccttgattgtgaaatgatgatgaaataaaccttcattatggtgtgtcaaaga

SEQ ID NO: 402780 - DNA, 565 bp, Homo sapiens
  misc_feature (24)..(24): n is a, c, g, or t
  misc_feature (34)..(34): n is a, c, g, or t
  misc_feature (50)..(50): n is a, c, g, or t
ctggagcggttttctcagtgctcnatgttgcccnggctggagtgcagtgnttacagtcttggctcactgcagcctctgcctcctgtgttctatgcaattctcatgcctcagcttcccgagtagctgggactacaggcatgcaccaccatgcctggctaattttttgtattttagtggagacagtgtttcactatgttgcccagggtggtcttgaactcctgagctcaggcaatcctcctgcctcggccttccaaaatgttaggattacaggcgtgagccatgaaacctggcctcagatacaacagctttctgatactacagagtcactccagctaaatgcaggaggtttgtcaatttctttgagacaatgggaaataataatggaaaacttttaaaaacaattgaatttaaattggtgggttttttcttcaaaagtgttatcctggattaaattttacactgttgaccttatttgaatatttactatctggccaatcaagatatgcttttgatttgttttgggtttactctagaataattgtctccagattttatggggggaatc

SEQ ID NO: 402781 - DNA, 314 bp, Homo sapiens
tggggtctaagaggaggagaaaggctgggggattcctttggggagggggttgagttggatcctgaaggttctacaggaagccattgggggccctctgtatttgttgttttcacagattgacgttttttgggacatgtgttttgagggttttgtcccataccatacctcactggttctataactcctcctcaccctttgccccaacactgctaaatcatcgatcaacagaaaccccaggtttgaccctgcttctggtgggtgcccagcagcagctgtgctggagcacactactgctaattcccccccacactgaa

SEQ ID NO: 402782 - DNA, 555 bp, Homo sapiens
ccctacccccctcttacatgaaaattgtgtacttttaaatatctcaccctttcccctttaaaattggagccctcaaaatcatcttcggagaaaggcgtagacctgtctccccggcgtggtgtccttaactttggcaaataaacctcctaaaatgattgagacttgtctcatcatttttctcgattgacagagcttaagggcaaaatgtggtcttttaataaagtatctttaagcatttatgctcctgtaaaagatccctccattgatatatctgttggattttgtgagagagcagaggcaaagtcatgttttcactctctgctgactttaacagaaagcctccattaaaaaaaagtgtataggccaggcatggtggctcacacctgtaatcccagcactttgggaggccaaagcaggtggattacctgaggtcaggagttcaagacaagcctggccaacatagcgagaccctgtctctaccaaaaatacaaaaattatctgggtgtggtggtgcatgcctgtaatctcagctactctagaggttgaggcagaaga

SEQ ID NO: 402783 - DNA, 467 bp, Homo sapiens
ctgtcatctcagctactgaggaggctgaggtgggagaatcacttgagcttgggaggtcaagtctgcagagagccccaccattgcactccagcctgggtgacagagtgaaaccctctctcaaaaaaataataataataataaaataataaaaataaaaataaaataacaggaaaaagtgggagataagatagatgaagtgtgaaattgtgaagaatcttttattcagccaaagactttggacttgatgctgtagatagtcaggaaaccattgggaaattttaagtaatggtaaggggcaaaggagggggtggatactagaggaccgatttgaaagcgattgtagaaagtattaagaaatgacaggatttgttacattcgatataagacagagtgaataactgaggataggccaggtgtggtatgcctgtaatcccagcactttgggaggctgaggcaggcagatcacg

SEQ ID NO: 402784 - DNA, 253 bp, Homo sapiens
ggaaaagtagtttaaatatggtgccagctgtggcatatgactgcctcaggcagttagaaatgtttccactgatacctctgagagagaaaatcatcactcaatctaaccataaaagctacatagagacaaaaatcaatcattctaaaagagcaaagaaaaatatcatgatcctcaggggcatcaataataaacacacacacacacacacacacacacacacacacacacatatacatatacacacacacacacc

SEQ ID NO: 402785 - DNA, 474 bp, Homo sapiens
  misc_feature (451)..(451): n is a, c, g, or t
agagaacggttatcctgatttcaccactaggaaaacactggccaacaaatttgattgtccggttaacgtgataaacgtaagttcaacctcgtatgcatgtttcttagatttttttttttttttaggaaaggtctcactccagtcgcccagtctggagtgcaatggagcgatcacggctcactgcagcctcaacttcctgggctcaggcgactccccaacctcagcgctccccatttagtagcaaggactacaagctcccaccaccacactgggctttgtattttttgtaaagatgggagtcctgccatgttgcccgggctggtgtcgaactcctggggtcaagcaatgcacccatctcggcctcccaaagtgctaggattacaggcgtaagccaccgcaacaggcctatatttttcatattgtgtgtgtgtgtacaattttctctcaaatnggttctggatacacatgatcttg

SEQ ID NO: 402786 - DNA, 609 bp, Homo sapiens
atgcaggaaacagactcagaattgtgcttcaggtgggaccgttgaagtttgttcctggaaccagactaaggatcctatcataagtacccttgcccaccacacccaccctttttaaatataatcttgacacatatcataaaagttgaaactacatttcaaaatcatatttggctttagtgttagaataaccaatcccaacaatactaaaatactggacttgccattttcttttcatgcttcattttaaaaacatttaaaaagcttggatgtattgagtaaatctggctgttatcatttggtgggattacattctgtataggataaattttaaatttctgttcctctgcttgttctgttgagtctgtattaactgcttgaagcagttaatacagactcaaaaagcaatgtgctcaaattgcttaagctaaggtgtagggcagaaactccttatactacccactctaagtataaccccaaactcaccaaagcaaatgggctgaacttggggaaaaatatgcaaattcatggatttcctggctagtgctactattttgagaaacagacacgtacacacctctaccttccaactccacaagaattactccatgg

SEQ ID NO: 402787 - DNA, 225 bp, Homo sapiens
acaatgaagaatagatttttgagatgagatgcagtaaattgatgacattatttttgactcaatttatgatttgcggcttcttatttggaatattttctttgtctatagaatttccttaggtctcctgcttctcttccacctattctgtgttccttgccatatcttccctatacccaagctcagacttctagtgcattgcccagcattcacttctgctgttatatc

SEQ ID NO: 402788 - DNA, 424 bp, Homo sapiens
gtcctggatactaggactagagaagtcttgtccagcaggcggatatctgaagagtatagcagtggacagtcaatgatttaagcagtcaccttgcaggttagcttacgtgaaatagaaaggtagaaggagttaggccactttgcatcaggagccctaagggtctgtggccatttggaagacaagtagggagaatggttacctgcatggcttccagtgcttacggagagaggaggggaatatggcatggcaaagtggggatgaaggttatcagttaggtgtgaagtctgagattggcaaataaagcaggaatcataatatcaaaggtgatggacaacacgggagagaggcacaaagtgttgggaccatgaagagttgtccagcttccagagctggagcataaagttaggaccagaggactagcctg

SEQ ID NO: 402789 - DNA, 358 bp, Homo sapiens
tctacacttccattatagtatttctatcaaactataaatttaaaagtctcacttctacaagttcagggatccatactcccaaggtttccacaaatcctctaaattataggcaaaattttataggttcattttcttactgggaaagagttcagagctcacatcagtttctcaaaggagtctataattactctctcatgagttctagagttctttgagtttctacagatagatgcctaatattagctgaatgagcatttcagttattgtttagaggtagctgcttattctagtaaagatatatactaaattcaacttcctctgtttttttatttaagtggatagaaagtgtgatactgtg

SEQ ID NO: 402790 - DNA, 459 bp, Homo sapiens
ctggtaacttcccttctgctttttgcttctatgagtttggcttttttatatttcacaccaaggtgagaacatgcagtatttgtttttctgtgcctggcttatttcacttaacatgatgtccttaggttcacccaggttttcacaatgacaggatttccttcttttttaaagccaaatagtattccattgtgtatacatactacattttctttatccattcatccattgatggactctttggttgaatccgtatcttggctactgtgaatggtgctgcaataagcgtgagagtgcagatctctctcctttctttcatttaaatacattcttttatttgaaaatttgtgttttttcattttctttttaaaaatgttttcatttttaatttttatgggttttcggcggcaacaacttcgtccaccaggatatgaagaagtgtttgggtcctcggcgtgtgca

SEQ ID NO: 402791 - DNA, 296 bp, Homo sapiens
tctgagctagggaataaagtaaacaggcatctagcaacaggggagatgcaagaatggagaagacaagttgttcacgaatcctgcttctgttccctcactgtctacaaggaccacatggaacagtgaaaaccacacaggcttgaaccctatcgttacgacttcatggccttatgaccccagacaagttccagggatgatgctctacccataggcttactatgtggaatagaggaaaacagacgtgaaccaaactgctcatgcatggagctgtgaactacaatgctggcccctcaggt

SEQ ID NO: 402792 - DNA, 355 bp, Homo sapiens
ttgtggcaaatgctacagtaatgaccagacacatcacacccgccttctagaagccctccctcacaaaccggatcaactgctatgataaagtgtccactaccattccttgagggcttacaatggcttctggttgggagaaagatgggaagaggaggacattcaagaagatcagagacgtctggggtgtgcagaagtatttttccttcttattttcctgtattcaataggtaacaccatggtgtgtggcttttctgggcagcctgcaaatgtcattgctagtgacaacatttttctgcaggaaaacatattccagcttttaatcatctttagaataaacccatttataagcagtata

SEQ ID NO: 402793 - DNA, 601 bp, Homo sapiens
ttcatgcctcctaaaatcaaaggcttttcacatttcatatttccaagtgttgtcataagtctgactttggaatcatcatttacactattcatagttcttttcatctatcaaatgttataacctgttgttccctggattctgtatgaaaccagagctcttctgcttttgtgtccaaatattctctctgaattttccctcgagtcattaaaaaagaactattatctgactcttccatgatttgtctctggataggaagccccaaattgcattagttgtttttattatcctaatacactgaaagcctgattttactataatttgttcttcactttcatcccagccctaggtctcctgataatactgctttctaaattgtgtctattaaatgccttatttgatattattatttcacagattcatatcttacatttacccaagtttcatttcatttcttctttcttctttgtaacctctttagattcttttgtgctagttatcttttttctgagaattgaaagtagttcccaaattatagccaactacaaatttccttagtgttcttttgacctcactttccaacggtctcactaaataagacaga

SEQ ID NO: 402794 - DNA, 353 bp, Homo sapiens
gacagaacctgaaatctacttggagtttggggaatcagagttttagttgtgattcatttgtgaactttgacagctttgttgtcttctctgagctttaggttttggaaatgagatatgagttatagggtgtcagaacaggttctgggcttgtatttaaggttctgctttctctttcttagcatgtcatccagtcctaacaccaggaatgtagtttctgttccagtatttgttaggagttgggacagcttgggtattggcaggcttccttggttctgcctggcctggaagtgtatctttccttccaccgtgccatgtgggaccacaaaggagaatgccatgtaccaattattgta

SEQ ID NO: 402795 - DNA, 610 bp, Homo sapiens
tgacagagtgaaactccgtctcaaaaaacaaaaaaaaacctgctatctttccccaagttaataaccatatgcagtaatatttcagttataatatttttcctcgcaataacatatttattttatttctttagaataaatgtagtcagtaatttcttctacctttttataagattataaaatatgcctaaaattaaggtttccaaaaaagtgataatcttctctaaagtcaaattctatacattgataaaaatgactattttatcagtatcaaaatgttaacttctgtttttatatatttaaataaaatatacagcatactaaacttcgttttaagtcagtagcccacataagaagtcattatactagaaccagagcatttaacaggtatcttcgatacaatctatgctgggtttaaaaaaatttttgctacctatattatgaagccaaccccacttgaatttgacttacaattttaacactgaagttctctcacaatatatcagataagttatttcgttgtttagactgagtactacttgaaggcagtttgcataagttgctcatctcagtgcatacaacagctaggtaatagcaggcactcagatacttg

SEQ ID NO: 402796 - DNA, 122 bp, Homo sapiens
ccgccccccccccccgccccccgcaaaccttcctattgccccctcttccccgcacccagtgctccttccgagaaagtacggctggagcggactggggagacggaaatattgagtcgcggccg

SEQ ID NO: 402797 - DNA, 480 bp, Homo sapiens
cagaaaacgaatatacaaatccatttacaaaaacaaagcaaaaccgttgtgagaggtgagagctgggcttgaaggttggagggagtagcggaaggtcccagtgagctgcagggggtctctgtgatggaaaggtggcttcctcagacaaggaaggtgctgcgaatgggggaagacagaatccaacaaagaaagagaccacacaccccacacgcacacaggcacgttcacacacacatacacagtccacttagcccagcactgcagtcactcacagggacacactcagtctcaacccttccatcccatacacggccaggggcgtggctcaaaggaaattgactcatgccctccaaagccatggacgacaacaactccacactggcctttgtgttcattcacaacctcccaacagagcatacacatgaacacacacatgcacacatacccacacacgcacacatacccacacacacacacaca

SEQ ID NO: 402798 - DNA, 350 bp, Homo sapiens
tgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctgg

SEQ ID NO: 402799 - DNA, 494 bp, Homo sapiens
ccagcagcagcagaatacacaatcatctcatcaacacatggaacattctccaggatagaccatatgttaagacacagaacaaggctcaataaaattttaaaaattaaaatcatatcaagtatcttctcagaccacaatggaataaaacttgaaatcaataagaagaagaaatttggaaactgtacaaatacatggacattaaacatgctattgaataatcattgggtcaatgaagaaattaagatggacatcaaaaattttttttaaacagaaaatggaaacacatcatgcaaaacctatgggatacagcaaaagcagtactaggaggaaagtttatagcaataaatgcctacaccaaaaaagtagaaagattttaaataaacaacctaatgatgcacctcaaggaattcaaaaagcaagaacaaatcaaacacacaattagtagaaagaaaaaatataaataaaatagcagaaccaaatgcaacagagacaaa

SEQ ID NO: 402800 - DNA, 1463 bp, Homo sapiens
  misc_feature (57)..(58): n is a, c, g, or t
  misc_feature (67)..(67): n is a, c, g, or t
  misc_feature (352)..(353): n is a, c, g, or t
agaaaactgtccaagaaactaaccttccttgggtcactcttcttcccatggctttanngtggcgatnaaagtcacaggaatggactcctggatgcatcactcaagtcaaagcctggaaacctgagagagagagcaaccccagacagcccagaggaatgtcctggatatccatgtgaagaaataggagatcttaagctgaaaatcataaaagataagtaaatgagtaagggctattcatcctactcagtcccactcctaccttatcagatactttcagttatttctacttttcctctcgagattcgctgtgagatactagaacttctttttgatgcatacttgtgggaagatnntgattatccatgagattacagttgtaacttcatagactcccaaagggaaattcttgaaagatcactctggctgacagataggaggatgggctgggaggcaagaaactgcagactgggaccaaacaggaggataacagcaatgagcagagataaggtctcactacgttgcccaggctggcctcaaactcctgggctcaaacaatcctcctgcctcagcctcccaaagtgctgggattacaagtgtgagtgaccatgcctggccaacccacagctttcaaagcgtgctgatttcaactgctactctgatgcagaatatcatactgactggacctggcgagcaggaaaagttgcaaacaccctagatgccttagtaagatacctgtgtgttacaggatggagagcctgactggctcatggagaaagcctacctaagaatgaaggcgggacccggcagaatggctcctgtgaagaagggtggcaagaagaaaaagggccgttctgccatcaatgaggtggtgacccgagaatacacccatcaacattcacaagtgcatccatggagtgggcttcaagaagcatgccccttgagcactcaaagagattcggaaatttgtcaggaaggagatgggaactctagatgtgcacaactgataccaggctcaacaaggctgtctgggccaaaggaataaggaatgtcccatgccgaatccatgtgcagttgtccagagaatataatgaggatgaagattcaccaaataagctctgtacttcggttacctatgtacctgttaccactttcaaaaatctatagacagtcattgtggatgagaactaatcactgattgtcaactatatcaaacaaagttataaaactgcaaaaaaaaaaaaaaaaatgaagccaacaccaaggaaaacaaagatgtcttcatgtgtatgacagaacaagtaacagactaacagaagctgcacacatgctcaagaaatagagatgcacgcagagacctgacaacatcctgtgcgcctatatccagccaaagcatccagcagactgacctcatgatttttcacatacatgaaccaataaattcccttttttgtttaagccacttt

SEQ ID NO: 402801 - DNA, 416 bp, Homo sapiens
aaaacaaattcaacagtatattaagaagatcattcatcggccaggcgcagtggctcatgcctgtaatcccagcactttgggaggccaaggtgggcggatcacctgaggtcgggagttcaagaccagcttgatcaacatggagaaaccccatgtctactgaaaatacaaaattagccaggcatggtggcatatgcctgtaatctcacctcccaaagtgctgggattacaagtgtgagtgaccatgcctggccaacccacagctttcaaagcgtgctgatttcaactgctactctgatgcaggtaggaatacatttattctccccctcatatataagaacatgaaagtgcagggtgggggagacttgccttattttatgtaactaggctttccactgaaaacaactagaatgatgaat

SEQ ID NO: 402802 - DNA, 424 bp, Homo sapiens
tgatttttaagagtgcttaccttttagagctacatactggaatatttatagatgaaataatatgaaacatttatggctgtatatatctgagatttttcttcagaatattccaggagggggcgtgatgggggcatagatgaaacaagattggccatgacttgataattgtcaggtgataattgttggtgataggtacctggagtcaattttatgatagactctaattttatatgtgtttaaaaactttccataacaaaataccaattacctctccctgccaagaattaataaatgaataaaccaatcagtaaaccaattaataccatctatttgtaataccttgagtgggttttgtatttctgtctacagcctgactggctcatggagaaagcctacctaagaatgaaggcgggacccggcagaa

SEQ ID NO: 402803 - DNA, 1206 bp, Homo sapiens
cgacatcagtctccagagtgaatccaaggagtggacccaagacatttgtgttctgtgatgtggtggcatgttacctgtcatctccgatgcataactcctaaagtgcgtctggggcagttgtacagattgcagaggataatactcaagatgttctccaaggccaactagtcatcagtttattcatagctcccaagatggtggtgggccacttccaagatggtggcaagagtcgtattctctgacctggggttcttggtctcatggattccaaggaatggaatcttgcgccatgtggagaagcgtcagataattaggcagcagtccaacaattaggttttgtggaacttttactatgtcatctatttattggaattccccctggataccaggaccccctccagcagagcttaaagttatagttacaggaagtacaaattccttatgtggatccctggaagtgtgatgagaagaaccactgtttccaagatctatttattctatttatcaggcctataaaatcatgtaatggccatggcttcaactagactccacatcttgaatcacagaactcaacgaatggcatcaactacaagctggtattctgctatacatttaagaggccattttaatattctattagtctagcagcttctaagtgatgagggatatggggggactggaggatcccgtgctcacttccttttctgtaaaaggagctctttgatccaaggtgacatggtatgggatccaatgacaataaatcagttattctgtgaaccctgatcaaaacttgactcaacttttgacagttaggttttttcctgaccacagactcctcacctttcttttcttagaaaatttacattggaaaacagatgtaaattttctccagcctcttgcaaggtttacagtccaggactttgaggtcctgggagtcatccttttgaaatacaatcatcaaagaagatagtgctccaatctcctagtctctgtgggagggttggaacctaacttcagtaaactaatcaccaattagcaaacacagaggggctgatcatactgacccactttcccactaaaatgtctagtactttccaccagctcaccacagtgcttaaaaactctcctgtcttttgttttactagagttgagtccaatctctttcatctattgcaatagtgttgaataaagtcttccttgcctaac

SEQ ID NO: 402804 - DNA, 498 bp, Homo sapiens
ctcatctataagcaaggacacctctggaagacgcaaggcctggatgtcacagccagccttatcaataaacaatcttctgccttgacagacggaagaggaagggccaattcaatgaatactcagatcaagtgtctgtctggaaagctggcagtcttccagaaatacaattagggcccattccagtggaacagaagtgctactttgggggtggactgaaacaagttgctgggcttccattggccattgccacttgcttgtcgttgtgaggaggggccgtgcctccacaggcccatacctgtaacctgacgatactgttgtgagcgggaatggaggaagtgcatggaagcccctcagcacgatgcatagtgaacagacaagctgtgaaccttgggagttatcaccatgtgtgatgatgctggtgaagaaagcctgcactgcggaggctgacagcctgggtttgaatcccctcatttggaatataatcttggcaaagtcaaa

SEQ ID NO: 402805 - DNA, 385 bp, Homo sapiens
gcatcttcaatacgtctgcgtcaaagggagcagaatagggcagaagagaaggactgggagagactcgagaaacaaaaccaccaggtttgagggataatctttgaaggatttgaacaaacctgctgtaaagacatttcaaagggggtcgggcacagtggctcatgcctgtaatcccagcactttgggaggctgaggcaggcggatcacctgaggtggagagttcaagactagcttgaccaacatggagaaaccctgtctctactaaaaatacaaaaaaattagttgggcatggtggcacatgccagctactccggaggctgaggcgggagaatcgctcgaacccgggaggtggaggttgcggtgagccgagatcgcgccattgcac

SEQ ID NO: 402806 - DNA, 742 bp, Homo sapiens
tcagtggtttacatgcctctgaaactatgtgcaatatttttggttgacacttgtatccatccttaagaaattagtgcagattgcagatgttctgtcttccatcccaaacaagcctgccatgaggtaggatcctaggggtttggctgttcttactccactgctcagaaagcttccattctgctgtcctcagcctcgaccctcttctgtgctggacttccacccacccacccttttcaagtttagatagtgtttcagctgctgtcccaaagtaacaaaacaatacctactgttaagtaggaagtcaatctgtgtgctggttttgttggttatgtggaaatcacaaactccagaggagcaaaggggtttttcaatgtcttttgctttcagaaacagagaatataatattctcactaaggccttgaattgatttttttctcataaaatagtctgataagctaatttttaaaaagaaatgccattaactgtgttgtatcgtggtttaaaattactaacaagttgtgggaaagaaaaataatatttgattttgaatcttaaatgtttttaaaaattagacttgaatgggcacaaagtataaatattttgtttctttatggaggacatgtggaaggagtttgagggtttgggatgggagaagtattttgcagagctatcaatgtccaaataatttaaaaaaaaaaataaaggtatttaagcagtgaaaaacaacaaaaacaacaaaaaa

SEQ ID NO: 402807 - DNA, 735 bp, Homo sapiens
gaaggcagggaccactttttccagggatttgtttccctatgctagtgctccattcacccttgcaccacttcagcaaagcacatagtaggtgtagcagggagatgttaagatggaaacttggccctgaccataggccaagccagggtgtctagtcgggatttatccataaacatcaatatttatcactagatgatatattgatttcttatctgcctcctatacctattgatctatttttcacagcttatagtggggagggtcatgttcagttattatccttaaaccaaaacaatctcttcttgaaaaataggatgctatgctctgatgtttgcagaggccaggaaattcttgctctgagagttccagaaaaaaagatttgtccagatttgaactaatttcagaaaaacaaaacaaaaacaaaaaaccatccaaggttaagaggtgacttctgactcacagaatgaacaagaaggcaggggaaaaaataagtcccccaagattcaggtcaaaggaaatgaacagaaggatgatggagtggcccagaggaggatcacgtgacagaaaagtcaagataaattagtggcaggacagaggaaaagaactaaagacctgcaggatcctgaaagaaagaatgaaaggaagcagatgaagattctagagcccagctgaatagccaggccgcctgagggtaaagagggagagaaagaggaagcagtgaatcaaatcaaaaaaaaa

SEQ ID NO: 402808 - DNA, 330 bp, Homo sapiens
aaaaggcggagggagcgcatgtggcccaggtccacgcggaacacgccgcaaatctgctccagggcgcacacccgctgcggctcgtcccagcgtggggtctgcaggaggccgttgctgtccgggaaccgcaggccggcgtcggagctggacggggggctggtggaacaggttatgtgatgatcgccacacttctccctgcccacactacccagagggggacgggggtcatgggggagtcatttaaacctacgcaccaagcttaaacacacatacaggcacggctgaatatgccctgtaaacccctgtgaataaatgaatgtatgaacccca

SEQ ID NO: 402809 - DNA, 209 bp, Homo sapiens
gtgtgttcatttaagaacaatgggcaaggctcaagacaaaataatacaggaccgtcgcatttctttttctttatcccaccctccccaacctgagagttcacacacaggattgtattcttatattttctttctattcctccagtgaaaactcaaagatcaaatacactcatttaccttaagccataataaagctaaccaatgaggcttac

SEQ ID NO: 402810 - DNA, 360 bp, Homo sapiens
tgctgggattacaggcgtgagccaccacgcccggccaggattattattttaatgtaaagaagtagcaaatgtgttaagtttaccaagatttatttttattttattttattttattttttgagacaggatctcactgtgttgcccagggtggagtgcagtggcgtgaagtcggctcactgcaactcccctccttccgggttcaagcgatcctgtcacctcagcctcccaggtagctgggactacaggtgcccaccaccatgcctagctaacttgtgtattttttagtggagacggggtttcaccatgttggccaggctagtctcaaactcctgacctcaagtaatccgcccgccttggcct

SEQ ID NO: 402811 - DNA, 595 bp, Homo sapiens
aatatgcgcagtcatctctgggctttttatgtgtcactcattgatgagaaccaaaactggacaagattagaagtgaggctttccttctttccaagattggattttctgttccacccagaacaacctgctgttccccagctgcacgccctggtttcaagtaggtctaaaattacaagagaatcaccttgctccaaggaagctggcatctctgtttcctgatgaaagtaggtactagagagtggagctacccagaaaccagggggtggcatgttggccatgtggaggcaaacagagctgtgttttcttttcttggccttcttaaagatgtatctaatttggggcatgttttgtttggttcatcttgtatctggagaggttcttcttttctccctaagtgacatccctcttgagcccacaattccctcttctcaaggtgagtaatcctctctctagctgttcataattgctaattagtgaacaaagaggctaaccaacaaaattagctattgggccagggtttaggattgaaccaaagggtggagaagggctttagtctgcttgttttttatttgtttgggttttttttccttaaaaa

SEQ ID NO: 402812 - DNA, 151 bp, Homo sapiens
ggctaggtttcaagagtagggaactgcccagagattatcctccctccaaaaaacccctagtgcgttacattctataccttctcccctagtccgttttattttccgtatcaaagagaatgctcaggattcagccccctcatcagtagcaaga

SEQ ID NO: 402813 - DNA, 212 bp, Homo sapiens
acacacacacacgcacacacacacagagttgacccttgagcaacacaggtttgaactgtatgggttcacttataatgtagattttcttttgcctctgccacccctcaacaaaaccaacctctcctcttcctcctccttagcctattcaatgtgaagataatgaagatgaagatctttatgattgatgatctacttccgcttaatgaatagta

SEQ ID NO: 402814 - DNA, 461 bp, Homo sapiens
agtggtttttgtaattgtgatcgcccacattttgcatgttgttggcagattggggtgggggaaattgtgttgaacttcctttaaaagtttgtatatttttaagtagtttggagactcagaactgttcagaatacttccctttttaaaaaaaataatataaaactgttaatagtatgatatttatagtggcaaaaccatggaaacaaatggagttcctaaaattagggaataattgaaatgaattatggtatatccatactttgcaatgttacacaactttcaaaatgagttacatctgttcaaagtatttctgataggttaagattagcagtaggatctcattaaaattaattgccttagttgctgattttatttacttctgatatttttctaagttaatgatcaaagcatatttgctgatcattggttaataatttaaaatcaaggtatggaaaaaaaaa

SEQ ID NO: 402815 - DNA, 180 bp, Homo sapiens
gcatgaggcaccgtgctggccggcaaatcctgttttctagactacatctggaatttgatcacttcccatcaatcctgtcactcccactcagattattttggtaatgtcctaactgacctacttgtgtctgccctcatccctctattcatcccagcctccagggcgagcctttgaacacac

SEQ ID NO: 402816 - DNA, 613 bp, Homo sapiens
ataatatatcaggactgcattggatttgtgcaagattgtcttaacattaattgaccccattgacagcttaaggggaaaaaatgtgatcatctcattggatacagaaaaagtagtaggtaaaatccaatagccatttatgacaaaaatttttagcaaactgggaatagaagggaactttcttaaatggctgaaatatcagcagagttctacagtaagtttacttaatgtttaaatactaaaagcattcctttcaagaacagaataaggatgcatgctatcactacttctattcaattatggagttcctaactagaataataaaacagaaaataagaaaaatagaaaaaattatcacttgtggttggtaattattgtctacatagaaaattctctatgtagacaataattttctatgtagataataactaccaactacaagtgacaattttgtttctatttttcttattttagaattaagaaagtttggggccaggtgtagtggctcacacctgtaatctcagcactttggaaggccaaggtgggaggatcacttgagcttaggagttggagaccagcctgagagacataggaagaccccatctttacagaaaaa

SEQ ID NO: 402817 - DNA, 340 bp, Homo sapiens
tacattttgttctcaatagtgtacattaagcacacttgcacatttaaagtattcatggaatttataatatagtatttcaaacaaagtaacaaataacttcctatcacagtccatcatctatacccccttcctccagctcccccagaaaacaccagctgctctatcaccttttaacctacaaaactcaaaggatgatatctctgcatatttattggttccctttccctggggcagaaggtaattaatttgacttaaaaatcctcctcttcaaattccttccaggctagataagctaagatcctgtttatgtaaacaaaagtgctttattaaactgagcatg

SEQ ID NO: 402818 - DNA, 287 bp, Homo sapiens
ctagatctaacacgtggaaaagagagacagaaggaaggatgatgggagaggaagagtcttcaactgcagtgcagtgagaaagtttttacaaagtcaagggggagtccttgatccaaagctgcctgttcgaggagtcctgtgtctccacgaacagacgcgccttagttctttggctgggatcagctcgtgggaagcaaaccagagccttcctgtgtgaaccacagatgggtttcacacaggaaggctgtggtttgcttcgcaggggggtacgcgagctcgaaatgcgt

SEQ ID NO: 402819 - DNA, 268 bp, Homo sapiens
tctgccatgtgcagttactgttctggatgttggagatgtgataatgaactagacccatccagtcctgctcttcaggaatgtggtttaggtcaaaaggcaattgattagagcctgccttttcccacttgcttgccatgtgcttttaacagttgcctgggccttaatctccttttcctggccttatttatatagcaatgacaaacacacatgttcacttaccagccccacctcttgcattcaaagcaaacatcactaatcaatctgtctc

SEQ ID NO: 402820 - DNA, 343 bp, Homo sapiens
agactgtgattcctgggggaattttctgtgctttgtgcctggtagatagggggaaggatgttgcagatacagaaattcgtttcttttattatctgcttggcgtttttcatgtctctggccccagggatcatttcagcttcagacttgagttctgggatattgctggtgataatcttggtgctgggtattttttttttttttttcgattttctgttggggagagtgaagccagattgtttctactctgagattttggcgttgccacagatatgtacacatatactaatccttatcagcggtataaaattgtatgcacttcctcacttatgtaccttttaacata

SEQ ID NO: 402821 - DNA, 654 bp, Homo sapiens
attgatgatatttttgagttccctaagtgagaatgctacattagatgcttttatatggcattaaatactactcctacctaagcggtttttcctgttcttaacatcttgaattagtatggtacatttgttacaactgatgaaccaatatcgatacattattatattaactaaagtctatagtttaattaggattcactctttgtgttggatagtcttacggtttttaccaaatgcctattatgtctctgttgttataataccatacagaatggtttcagtgccctaaaaatcagtgcttcacctattcatcgccttcttctcccctctccctgagtgcctagtaaccactgatcagtttactgtctcagtagatttgccttttcttgaatgtcctacagttgggaatcatgcagtatatagcctttcaaattggctttcatttaacgacataccttcaagattcctccatgtctttttagagcttggtaacttctctttatcactgaatagtatttcattttttgtttcattttgtggatgtaccatagtttgcttatccattccacctcctgaaagtatgtgataggtacaagagtcacagcccttatgacatgttggaacgcatcaggaaagaggttaaaggagacctggaaa

SEQ ID NO: 402822 - DNA, 395 bp, Homo sapiens
ttcaggcgcccaccaccacgcctggctaattttttgtgtatttttaatagagacggggtttcactatgttggccagactagtcttgaactcctgacctcatgatccgcctgcctcgacctcccaaagtgctgagattacaggcgtgagccaccgcacctagcccttagcctatgttaacattatagtgaggtactgtgggttaagaaaaaattaaatgactcaaccaacattatttcttactgcgtgtgtgttttttaattcaaaatagtgtaacattttctctttttggaagacaaaaaataactgaaataaataactgctagagattggcatttgggtggacagacagagacttagaatctagtgttggcggataggctttccttcctactcc

SEQ ID NO: 402823 - DNA, 724 bp, Homo sapiens
ccgtgagctaaggtgaaacaaccaggctgaaggctttgcatgctgcagtgctgggtacaaccatgtcagttcaaaccagattcaatttggttggttaatgtgcccatttcccattgctgccatacaaacttagtagcttcaacagtacaaatcaattacctgtataatcctggaggtcagaagtccaaaatggatctcactgagctaaaatcagtgtcgtcagggcagtgttcccttctggaggctgcagaaaagaaagtgttgtcttgttttttccagcttctagaggccgcccacattccttgactcatgggccccctttctctgtcttcagagccagcaacatcacagctctccgaccaatcattcttccattggccacttctccctctgacttggattcctcttctgcctccctcttcttcttttaggacccttgtgattacgttgggccaggacaatgtgcctgttttaaggttagctaactaacagccttaattccctttttcctgtcagggaacatgtttataggcttcaggaaataggccgtggacacctttgaggggccgttattctccctaccacatatagttagttggttgattgttagttgttcagttattggttgtttggtgttggatggctgttttttgtttgtttgtttgttttttgagaatctccttggctcaggtcctcacctgagagccagataatcacgtttgtt

SEQ ID NO: 402824 - DNA, 360 bp, Homo sapiens
ggcccccttgatctctagggcattaaaatatatgggagatttccacccttcctcacggggcttgcaggctgagggagtgagaatttcctcaccagcagcatgggcaaattcgtaaaaagaaagaaataatttgcttgtttttaatggccaccaaacttcaaagtctagtgaccaccaaccagtccctcctcagtgaacatggtcgaatacagaaaggctttctctggaagagcccagaaacctgctgtctcatttcaaaagccatcttccttccccgagacaaacatggtggaaaggaggcccgcctgataacactgagggttttggggccagatttttttctgcaggcagttttggaca

SEQ ID NO: 402825 - DNA, 5053 bp, Homo sapiens
gggaaaaaaaaaaaaactgtccaccaagaattctatacctaaatatcttttaagtgaaggtgacataaagatgtttccaaacacacaacagctgaactagttcattaccagcagaccttcactgaaagaaatgttacagatgctttaggctgaaggaaaacaaaaccatgtggaagtctggatctatacagaaaattgaagagtactggaaatggtaactacatggattcaacacaactgcaatcaaaatcccagcaggctattttgtagaaatcgagaagctgatcctgaaattcatatagaaatgcaaaggacctggaataattaaaacaacttcaacaatgaaaagcagagtttggggactcgcagtgcctgattgcagacccggtgcatttggactcactgtggcgtggggtcccagatgggaggaagcttcctgagaggtgacgcctgagttgagtctaagaggacaaggagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcggttggagtgggtggagatcatcgaaccgcgcacccgcgagcgcatgtacgccaacctggtcaccggtgagtgcgtgtgggacccgccggccggcgtccgcatcaagcgcaccagcgagaaccagtggtgggagctgttcgaccccaacacgtcccgcttctactactacaatgccagcacgcagcgcacggtgtggcaccggccgcagggctgcgacatcatcccgctggccaagctgcagacgctgaagcagaacacggagtccccgcgcgcctcggcggagagcagccccgggcgcggcagcagcgtcagccgtgagggcagcaccagctcctccctggagcccgagcccgacactgagaaagcgcaggagttgccagcgagggccgggcggcccgcggcgtttgggacagtgaaggaggacagcggcagctcttcaccaccaggagtgttccttgagaaggactatgagatttaccgggattacagtgcggacggccagcttcttcactacaggacctcctcgctgcggtggaactcgggcgccaaagagcgcatgctcatcaaggtcgctgatcgggagcccagcttcctcgccgcccagggcaatggctacgccccagacggcccacctggggtccgctcccgcagaccctccggcagccagcactcacccagcctgcagaccttcgccccggaggctgacggcaccatcttcttcccagagaggaggccgtcacccttcctgaagagggccgagctcccagggagcagctccccgctgctggcccagccccgaaagccctccggggactcgcagccctcctccccgcgctatggctatgaacccccgctctacgaggagcccccagtggagtaccaggcccccatctacgatgagccccccatggacgtgcaattcgaggctggcgggggctaccaggccggctctccccagcggtcgccgggccgtaagccccggccgttcctccagcccaacaagcagggccccccctcgccctgccagcagctggtgctcaccaagcagaagtgtcccgagcgcttcctgagcctggagtacagtcccgccggcaaggagtacgtgcggcagctggtctacgtggagcaggcgggctccagccccaagctgcgcgccggcccgcggcacaagtacgcgcccaaccccggcggtggttcgtactccttgcagcccagcccctgcctgctgagggaccagcgcctgggcgtcaagtccggagactacagcaccatggagggacctgagctgcggcacagccagccgcccacgccgctgccacaggcccaggaggatgccatgtcctggtccagccagcaggacaccctgtcctccacaggctactccccgggcacgcgcaagcggaagagcagaaagccctctttgtgccaagccaccagcgccacccccactgagggccccggggacctgcttgtggagcagcccctggccgaggaacagcccccgtgcgggaccagcctcgcccccgtgaagcgagcggaaggtgaggccgaaggggcgcggggcgcggccgagcccttcctggcgcaggctcggctggcctgggaggcgcagcaggcccacttccacatgaagcagaggagcagctgggactcccagcaggacggctctggctacgagagcgacggcgccctgccactgcccatgcccgggccggtggtgcgggccttcagcgaggacgaggcgctggcccagcaggagaacaggcactggaggaggggcaccttcgagaagctaggcttcccccagatcctgctggagaagagcgtctccgtgcagaccaacctggcctcaccagagccctacctccacccctcacagtctgaggacctcgctgcctgtgcccagttcgagagcagccggcagagccgcagcggcgttcccagctccagctgcgtcttccccactttcacgctgcgcaagccctcctcggagacggacatcgagaactgggcctccaagcacttcaacaagcacacgcagggcctcttccggcggaaggtgtccatcgccaacatgctggcctggagcagcgagtccatcaagaagcccatgatcgtgacaagcgaccggcacgtgaagaaggaggcctgcgagctcttcaagctgatccagatgtacatgggtgaccggcgggccaaggccgacccactgcacgtggccctggaggtggccaccaagggctggagcgtgcagggcctgcgggacgagctctacatccagctgtgccggcagaccaccgagaacttccgcctggagagcctggcccgcggctgggagctcatggccatctgcctggcctttttcccgcccacccccaagttccactcctacctggaaggctacatctaccggcacatggaccccgtcaatgacactaaaggggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgatagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 402826 - DNA, 755 bp, Homo sapiens
cagtgaccccgcctccacagggtccgttccgccacactgacccttccgtgtcgctcgcgggaccccacccctgtccgcctgctccggtgcccatggggaagcctggtgccaggggtcaccagtcagtccaattcaccgcccgactggtgggacaaggacaggtcagcgggtcacaggccggaagtgagactcgcccggccgctctgggacgcgggaagaccgaggcctcggtggttcccctctctcccgcctggctccctcaggagaaggagcggctaagtgcggcaccttcccgtctgatgctggcgttgtgcgtatggtgccctgacgtctgtccacgtgggcgcggaagcaaacagcgatgtcccagacgcaggactacgagtgcaggagccataatgtcgacctgccggagtcgaggattccagggtcgaacactcgctgcagtcctttgattcaaagatgcctccgccctccctccacgtgctcttctagatggagacaggaccagtcggccccacccagagaagacgttgggctttggactggaggcgtagggcggtgtggctgctggtgcagagtgtcctgggatttgatgaggtggttgctgcatcgggtggagctgcctccccacgtcctcacagagcaaacgcatctcctgctggcttcaccttgctgttgtgagccctcgttacagccctaaggctgttagggttctggtcgccctcctcccaggctccacaggcagtcagcca

SEQ ID NO: 402827 - DNA, 750 bp, Homo sapiens
aggtccctgagtccctcctcaggtgctgactcaggcacactgcccctcccctcagggaccctgctgtcgggctgagttttaggaagcccctcctttgagaaaggagactgggccctctcattgctgcctcagtccttcagaagagcccagaggtggtacttcaggcccagggctgcagcagagctgggcttgctgtgcagatagctcagtgcctgcctcccccagcactggctgcgggtgctgggtaggtggaaatgactcctccaggggctcctgcccacagcctaaaagccagggaggggcctgaagcagagaagagtcaaatacctggacagctccctgggtcaggccccggggagggagcagtggggtctagaggccctcagacccaggtcctgcccttcctgttcctgcgtggccgtaggagggcaggtggagctgccaggcggttcctcccaagcctgtccctctgcaggtggggaagtgctccttgggcctctgctctaaaggacactgcctgggagagtgtgaggacccgctgtgctgggcagggggtgaccggggcaaggccagcccagccccccagggccctcgaaggagctgtgtctgctcacccctctcctggccccacacccacacacccacaccaggctgatcaggccccattcctttccaggggtggcgataagcacgtatgccaagtactgttaccacaagctacagaaggcagccctgaccggggccaagaag

SEQ ID NO: 402828 - DNA, 1995 bp, Homo sapiens
aggatcccgaacgggtgatgcgggtggcgataagcacgtatgccaagtactgttaccacaagctacagaaggcagccctgaccggggccaagaaggggctgaagaagcccaacgtggaggagatccggcatgccaagaacgccgtgttcagcccgtccatgttcggcagcgcactgcaggaggtcatgggcatgcagagagagcgctaccccgagcgccagctgccctgggtgcagacacggctctctgaggaggtgctggcgctcaacggtgaccagacagagggcatcttcagggtccctggggacattgacgaggtgaatgccctgaagctgcaggtggaccagtggaaggtgcccacaggcctggaagacccccacgtccctgcgtccctgctgaagctgtggtaccgggagctggaggagcccctgatcccgcacgagttctacgagcagtgcatcgcgcactacgatagccccgaggcggcggtggccgtggtgcacgcgctgccccgcatcaaccgcatggtgctgtgctacctcatccgcttcctgcaggtcttcgtgcagccggccaacgtcgcggtcaccaagatggatgtcagcaacctggccatggtgatggcgcccaactgcttgcgctgccagtccgacgacccgcgcgtcatcttcgagaacacccgcaaggagatgtccttcctgcgggtgctcatccagcacctggacaccagcttcatggagggtgtgctgtagcgggggcgcccggggacaggagggatgtcctgccgcccccagccaggccgaactccgcactcgctctcccggcagaggggccagaatcgcccggcccagccctggagccccctccactcccccaggcccctggccccggcgctccccacgtcttctgcctggtctgagggtgcagccagggcacagcagcggcggggagggcgcctctggccccccacctcacggccagttcccgcgggcaccgcctcgccctccgctggccgcgggtcagctccgagaaagtgccttctgtgtcctggagccgagcgacgctgcctccttggggccgggctgcctccctgtggctcctgcgcgccctggcctgggccttgcccagccgccccggtctctccttccctttctcctgtcctcgtcctggcctgcagctcttcccagccccgagagagcttcccgacctgtccccgcctcctctccctccctcggcccgtggtccccagctggtgactgctcaggagtttgggggctccaggacagtgggcccggggcctggcaggctctcggtgggtggggtgggggcccccaaaccaaagtcctctggggtagggagcagggctgggcaggcattctgggggcagggtgggggaggggcgagagtatttttttcttcgtgtaactgtaaatccagaatctatcctgcatcgcagcccaccgtgtatagagatataaatagagggaaagatataagaactaaatttgctaatgacatagttttaacctaaatgctatttatctctgagccgtccccgtcctccgtgcagagcaagttgaggtcattccttcttttcttctccgatcttttttcttggcttctgaccaaaaaccaagctctaccccatccccatcccagacctgcaggagacgagcgagcgggaaggcgccgggcccgggactgtccgttctcggggccagagctgctgggggaccgagtttgtacattttccattttggaattttgagttccaattgttgtaaaacttaatttctccccagtttttatatatatattttttagagttccgtttttatttattaaaaacaaaagccccagccctgccgaggcctgggcggcgtcctcagtcgggtggtcccggggcctttgcggtcccgcccggctgagacgctcgccccgacgcatggacccgagaggcgacgacacgagtgaataaagtgcacatggaccctg

SEQ ID NO: 402829 - DNA, 397 bp, Homo sapiens
aatcacgaaagagactgtggatatggcaaagaaaacgtggaaggtgaagggttagctaacagacaccacaccagaggaattaaaagaccacttgatggagatgagctgcttccaaaccagtgccagatgatgaggaagaagacactaaagaagcagtgccagaaaataaattgacattagacaatttggcagaagggttctgattacttaagactgctttggacttcctttatgaatggacccttctattataccagcactgaaactaaagcaaatggaaagaggattgttactatacagaaacatttttagagaaatgaaaatgcaaaacggttcgtaaggttttcctgtaaagttacaccaagtgtgcctgcatctcctgaatcccattcgactt

SEQ ID NO: 402830 - DNA, 662 bp, Homo sapiens
gttaggaaggtttctaaaagtcctcattatcaatggtttatacagaaaaaaaataaatgcttggttagtgctagttttcaaaataatgaaattattttgtttgttcacaaacatcctccactggcaacaattagttttcctaatattctttttaacatttcattacaaaataacgaagtcgaatatatttgctgggtttcattcattatggttattaaatttaatgatgtttaaattgtcccatcttcagctggtgggagcctctaatgttgcctcctgagcctttctgacacgatcttattattctgtaatctcttccttgctttctagtaggacaaaatgtttcaggctgaaattgtacattccctgcctgagacctacaatcagccatttttccaaggagccctgggtccgtttgatgataaatgatttataatgatcacaatttggatgtcacaggttttcatcactactgaattgtccattgtttctagcttccagtagatggagatagataatatgcatttataaattacagggtttttacctcacttcatcagtcttacatctgattcttctttatcttatgctgagaatgctggttctcaatgacaccactttaattgatcattttcttcttatcacaatcagtcacaaaacag

SEQ ID NO: 402831 - DNA, 608 bp, Homo sapiens
gttaggaaggtttctaaaagtcctcattatcaatggtttatacagaaaaaaaataaatgcttggttagtgctagttttcaaaataatgaaattattttgtttgttcacaaacatcctccactggcaacaattagttttcctaatattctttttaacatttcattacaaaataacgaagtcgaatatatttgctgggtttcattcattatggttattaaatttaatgatgtttaaattgtcccatcttcagctggtgggagcctctaatgttgcctcctgagcctttctgacacgatcttattattctgtaatctcttccttgctttctagtaggacaaaatccaaggagccctgggtccgtttgatgataaatgatttataatgatcacaatttggatgtcacaggttttcatcactactgaattgtccattgtttctagcttccagtagatggagatagataatatgcatttataaattacagggtttttacctcacttcatcagtcttacatctgattcttctttatcttatgctgagaatgctggttctcaatgacaccactttaattgatcattttcttcttatcacaatcagtcacaaaacag

SEQ ID NO: 402832 - DNA, 266 bp, Homo sapiens
atctcttcttttttctacctgtcaaatcttattactgtagcacagcaaggctccccaatgggtcattatttcaaataatagtagttccactcccatttgactctcttatgccagcatttcctcgggaattgactcacacattcaagtcatacgtatgaactggcttccggtttcatctcagatatgtaaacggtgtgttcaaaatacttaaacatgtttcttgctatcaaatgcaacaaaaataaaatgaacaccatcataatgga

SEQ ID NO: 402833 - DNA, 373 bp, Homo sapiens
gtcttgcagattagcatttcatttatgtttactattgtctccttatgggcctatttcagagcccatctgaaacaaagtaggtgagaagaatgaaaaggacaaaggaaaggtggaaaggttgataaagaagatgggaagaaaaaggaagggagggaggcagagggaaggaaaattgaagctttcctgtatcccttagccatatctaagcatttcttcttctgggttcccacagtattgtttccatatctctattaaggcatttaccactatattctttttttttttttttttgacatactctcattctgtcacccaggatggagtgcaatgacaagatctcgtctcactgcaaacttcacctcctgggttcaag

SEQ ID NO: 402834 - DNA, 144 bp, Homo sapiens
cactgtgcttggctgagttcacaaatctgttgtaacctgtagcttccctgtcacttctctggctctcctctcctgctaagctttgtttcctaattaaaatcttctgccactgccatagctactgctgctactggaaccaccata

SEQ ID NO: 402835 - DNA, 791 bp, Homo sapiens
gtttagagattttttaggtgctaatgataccttgaagtgattgtctctctgtaggatatgacagacatatgtggaagcatcttcaagaactgattagaaaatgaaactctcggccgggcgcggtggctcacgcctgtaatcccagcactttgggaggccgaggcgggcggatcacgaggtcaggagatgcgaccatccggctaacatggtgaaaccccgtctctactaaaaatacaaaaaattagccgggcgtggtggcgggcgcctgtagtcccagctactcgggaggctgaggcaggagaatggcgtgaacccgggaggtggagcttgcagtgagccgagattgtgccactgcactccagcctgggcgacagagtgagactccatctcaaaaaaaataaaataaaacaaatgtgtaatatctcttacggagaaaaagcagcattcttagagacctgttcactgttgaagatgtttgtttctctgtttcactttatttatatgaatccttttaactgttatacctccttgctcacatgatctagtttatttggcttatttaggagcatctgtatttccatagaaagatatgtcaatactagtaagggattgtggacattcctatgtgcctaaaggagttccaaggagatctgtggatgtttgtttagtagtagtttttataatttggcatccacatttgtttagagattttttaggtgctaatgataccttgaagtgattgtctctctgtaggatatgacagacatatgtggaagcatcttcaagaactg

SEQ ID NO: 402836 - DNA, 384 bp, Homo sapiens
gcaagtcaggggctcagtgaatgctgactgtgagtgccatgggctgctccagggctcctcgtccaggtggccagagtggcatgcacgaggcagagagccgggcacccagcaggtaatgaacactgcagcgtgcccggtggtgagccagcagcccgtccaggaaaccagggctcagagacattgagcagcttgcccaaaatagttggccaacggagcaattaggggtttgaacacagttctctcagctggaaaggttgtgcctcttacctgtgtttcttgctgactatcctaaataccagactccaaagcttacaggattgaaaagtttggcttgaacatgaccaaaaataaaagctcctcttctaactattgtaagtcggagca

SEQ ID NO: 402837 - DNA, 476 bp, Homo sapiens
ctgttatccaggctggagtgcagtggtgtgatctcactgcagtctcaacctcccggggcccaagtgatccttctacttcagcctcccgagtagctgggactacaggtgtgtaccaccatgcctggctaattttgtatttatttatttatttttttttggagagacagggttttgccatgttgcccaggctagtctagaactcctgggctcagacaatctgcccgccttggcctcccaaagtgctaggattacaggcgtgagcccatgtgccccgcctattctgaattttctaagattgctctgatcatgtaacttgaaggaatatgatacatggttttgttcagggcctcaccatgggttgagtcccttgttggtgtttgaattgtcaattcgacatatgtgtgtatccatctgtatttttgttaacctgattctagatgtggttacaggcatctgactgcttcagaaaatcttcc

SEQ ID NO: 402838 - DNA, 296 bp, Homo sapiens
aaagactggatcactcaactctgccatgggtgccaggacccaatttttccctggctaactctgtcacctcctgtctgggatctccaactactaagtctcagctaaaacagcaattcaaaggcgaacttttttctgaggctccaggattgggccaggccctctccatggctttctgcccttcccctactgcagaacttagcacctgtatgtcactattggttaaaacatgtgcctttcatatgctctccacgttatctgcagcatctgcaaagaataataatgaatggtaaaaccta

SEQ ID NO: 402839 - DNA, 923 bp, Homo sapiens
  misc_feature (849)..(849): n is a, c, g, or t
ctcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccctcctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaanggctcttagatccaaacgtcaagtcaatttttgtcacctgtggaagactgggacttaaaagttcatgctcccag

SEQ ID NO: 402840 - DNA, 982 bp, Homo sapiens
  misc_feature (246)..(246): n is a, c, g, or t
  misc_feature (908)..(908): n is a, c, g, or t
ctcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggccccgaggagggggcgttgccatggcgacagcctctcccctgtgacggggggcngggggggccgccctcggaaagaagaggctgtctctgggcccccgcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaanggctcttagatccaaacgtcaagtcaatttttgtcacctgtggaagactgggacttaaaagttcatgctcccag

SEQ ID NO: 402841 - DNA, 884 bp, Homo sapiens
  misc_feature (810)..(810): n is a, c, g, or t
ctcgtggtgctggctgccgctgttcaggcggccgggaacgggcggtggggagcgggcggagctggccctgcctctgcctggccggcgccgcagtcggcgcgggccgcgcccgccgccgccaactgccctgagcgcttgctgaggccgagggagacgtcggggcctgcacctggagggagcctgccgcgctggcccctccccttactctcccctggacttggatgggcccgagttgggggcaacaccccgggcattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcggcaatggtgtccttccctccccagaggtatcactactttttagtgctggactttgaggccacgtgcgacaagccacagattcatcctcaggaaatcatcgagttccccatcctaaagctaaatggccggaccatggagattgagtctacctttcacatgtatgtccagcctgtagtccatccacagcttaccccattctgtacagagctcaccgggattattcaagccatggtggatggtcagccaagcctgcagcaagtgctggagagggtcgatgaatggatggcgaaggaanggctcttagatccaaacgtcaagtcaatttttgtcacctgtggaagactgggacttaaaagttcatgctcccag

SEQ ID NO: 402842 - DNA, 297 bp, Homo sapiens
gggggaagaggaaggaagagcgacagctctgcatgtagccatagccctgcattctctctcagttttgctaaggaacccagtgcatgcttgcatgctgctttgctggatcctcaacccaccttactcaggatttgaagagttgagaattgtattcctctttctaggatcatatagacttagatctttcttgacccagcgccaacatctgtcaagttgacaggggtgggagaacctggaaacagacacctctccagcccaccctgatttagactcctgaatctttcttgagacggagtc

SEQ ID NO: 402843 - DNA, 512 bp, Homo sapiens
agtgcattacagtgcttagaagattttgttttttgcttttaagttattttagactttaattcaattgccaataatctatttagatttcttcaaactaggcatgcagttaataattcatccatttcttcctgattcatagtcatttggagtcattttccagcacatggtggtacctcaggagtttttgaggcacacggggctatttgcttcagttctgtagtaatatttatttagtgtttttgtgcttggaattgtatggggcagtggagggaaataccaggatgactaaagaggatattttcatcagcagggagctcactgcgttaattcgtttccttaagtttccttttttattattttttatttttattttccctgaaagcacacattggtatcttgagtttttgaagccaaataatgagtataatgaaatggctcattagagcttatgtttgtaaccaaccctgaggagaattttgtttttgacattgaccctgttgatattgcctgaa

SEQ ID NO: 402844 - DNA, 468 bp, Homo sapiens
tcagcaatcatctcaaaagaaatgctcttggtgtgatggttgagagcgctgttctggaataggagagacacagacctgctgggcctttgcctcattttattacttagttcattatgcaatgaacttaacatctgtctacctcagtagtttccctgtctgtgaattgagtctgttacatatatatatatctatttaaatatatatatctatttaatatatattaaataatatatatttaaatagatatatatatattacagactcaatttaacccttagggaaatatatatgtatatatgtgtgtgtgtgtgtatatatacatatatatttaaataagatagagacctggtatggtggctcatgcctgtaattccagcactttgggaggctgaggcaggagagtcacttgagctcaggagtgggaaaccagcctgggcaacatagttggaccctgtctctacaaaaatg

SEQ ID NO: 402845 - DNA, 515 bp, Homo sapiens
ttgtctggagattggaaagagcctacttttttgttgtaatccttctgttcctttttcccccttttaatgtaaatgttattaaaacataacatccacatagaaagtgcacatactgataaattttcaccaacagaaacacacatgtaaccagcacccacaccaagaaacaaaatatgactcacactgaagaaagaccccatgtccctctggtctctgatctccaccgtagggaaaaccatctccagatttctgatcctaggtattagttttgttctttttaactttgtctttgtatatacccttttgtatgtcagttctttcactcattgttatatttgtgaggtttattcatgttgcttcacattgtggtggtttgtttattctcgtatagtatttcattagacgaacgttcaacaatgtgtgcatttgactgtgaatggacgtacagattattttctgctggaggccatcgctgaatggtattgctgtgacgtgtggacctatcttagtgaacg

SEQ ID NO: 402846 - DNA, 576 bp, Homo sapiens
ttgagatagggtctcactctgttgtccaggctggagggcagtagcatgatcctggctcactgaagccttctggattcaagccatcctcctacctcagcctcctgagtagctggaaccataggcatgtgccgccatgccaggctaatttaaaactttttttgtaggtacagggtggggatgtctccctgtgttgcccaggttggtctctgactcctgggctcaagtgatccttctgcctcagcctcccaaagtgctgggattacaggtgtgagccattgctcttggcccattttaaccattttaaactatgcacttctttacaaggattaaatataatataaatatgtgttaattagcataataccttaagtgcataaggtacctaagtgcttgataaatgtacaagtatgcagatgtgtgtgggtgggggtaaagtatagaggagataccaaaccacttagaaaatagtgtcaaattgactcctctaaacagaggccaaggtgggattagatagatacacaggagatttattggagaaaatgcctgtgaaggataaagtggtagggagctgaagta

SEQ ID NO: 402847 - DNA, 354 bp, Homo sapiens
ctcaatatagaagggacaatgatacatacgtatcaaggccaatcagttagaagtgcacagctatttttcatgtactcttcagatcattgttttggcagacagcaggttctggagtcagactgcctgtgctcaaatcccagctcttcaactagtaggtttaataaccctaggcaagtttagtaacctctgtgcctcagttccctcaggaaaggatagtattatctcagaggaaggtcagttgtaagaattacatagtatgtctgaatttgggttctcctgaaagaagaccctgagatgggtcttaggatcaggtagcttgttggggaggtgaaagagtggagggaggagttggaa

SEQ ID NO: 402848 - DNA, 620 bp, Homo sapiens
ataggggtggagcctggggtactgggtgcagagtgatgagactggcacggccaggcaggtgtatggctgggaagggtttcagatgggagaatgatggagtcagtgagtatgttttataaaccgctccagcagtccactgcatggaggtttgcttggtagggatgagactggagcctgctgcttttcagagagggctgtggctggagtaattgaggagggctcagaagagcaaatgcttttcattacaatgtatcattagacattaaaggtaagcagttggaaccaggaaatgcttttcattacaatgtatcattagacatcaaaccgtaagccattggaacgagatctaaagaacatgtaacctttcgaggaaggaacactaggttgggggtaaactgcaacatcctgaatctgtcagaaaacagctctgttaacagctcttcacatccctgagtctcaaatttctcatttatcaacaagcccactggagtaaataattcagaaggctccatccaagctctgatattctgaaatacaattttttcttgcttgcatttttgaaaaaattctctgctagttacaaaaaacaaatgtttattgtgaaaaacttggaaagtaca

SEQ ID NO: 402849 - DNA, 338 bp, Homo sapiens
aacaaggaaaaatgaacaaattggagaattcagtgcttggcaggcttgtcttcatatacatgatgaatatcagcctttcctgaagctttaaaattctcttggtctaagttacttttccttgaaggatcattcctgccccttgacatctttgagaattgttcaacatgtaaatgatgtgcatcaattgatcaacttacattttagcttctttatactatcagcgtattttttttctgtcactttcgtgttagtgaagtatagtagatatttgtaaaagtattgtgactatatattttttaatttttatttttgattatagtaaaaaatgcataacagaa

SEQ ID NO: 402850 - DNA, 721 bp, Homo sapiens
aaaaactgccaagaagaaaagagtgggaaagtttgaagaaaataaaatgtttaggcttgtgagaaaaaacaaaggacactgtaaaagaattgataagaaacttcactactcagcaaaggttaatctagtaatatatgagacaagtgaatattgaatttttttcattgtattaaaaagtaaaatgtctagtaggagaaatttgagtaagttagtaacacagagaaaagattatcttcatttcccatcagattaacaactgaagtgaatgtcagaagacacacaacgaagtcactctccaggtatacattgaatgataggtgaacaagttcagtcccaagggaaattagtgggcaaaatttatttgaaaaagtaattatctaaagtaaggaacccttttaagctctttgaactctgaaatgggaaattcctctcttaaagatctaaaaagactgggaaaaataaagtactatgcattctctcctttttaaaggaaaatgtagtgcctttcatccacctaaatctgaaataatttcactgtccttgccagtagtcctaaataaaaccaagctaacatggcattatctgctccacaagataaaatgggctgcacttcgaaaaaaacttttattcctcttaagacaatactcaaaataccaaacaaatttatgacaaatgaagatacagttgtctaaattaatgatttcaaaaagccacagtacaa

SEQ ID NO: 402851 - DNA, 281 bp, Homo sapiens
gcggccgcctactactactgctcgaattcaagcttctaacgatgtacggggacatgtacaaccggttttttcttatataggggtcttatctgtgtgaaagctatgtccacgtgtaggtgggctgaccgcgtgacaaaatgtagtactttgtcgacttaaagaaagttatcctggctgaggcaggagaatggagtgaacctgggaggaggagattttttattcctcgtttctagctcttaataggaaggtgggagacagtgagactcgttctaaaaaaaaaa

SEQ ID NO: 402852 - DNA, 178 bp, Homo sapiens
tactagtcattttttaaaaatttagctgttatgtcctcaaatctcttaaagattatccaacaggcattttgtattaggtctttaagaagtcagacaataggccagacgtagaaggtgcctggggtaggcttcatcttattaagcatatgctcctcatttctgtaggcattttggatca

SEQ ID NO: 402853 - DNA, 2019 bp, Homo sapiens
aacagagactgtggttgctgcggatggagggaccgctgatggtggctttgccttctccccggcagatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcaggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 402854 - DNA, 2492 bp, Homo sapiens
aggagtggagctaggagttcatggccctctgggcgtggcagggtacgtggtcatccccacgcggcgcgccactgccgtggccttgcagagcttcacctcccacctgctgggggacgccgggagcccctacctcattggctttgtgagtagccccggggtggggctggccgggggaggctgggggactgcaggagggctctgccctgacatccacccccaaatcctcgcagatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcagtgagtgggggggaggggaggccctgctgcaccgccgggaagcagggaccgtgatagccaccgtgagccctgccctggggtggggcggggagggtacagacctcccatgcactcagtgcacccactggttgctggggtccagccctgaggcccagtgccagggtcagcctggagctgtgggaggccacgggggtgtctggtggatccagacttgggtttgtctctggacttagtggttttcaaagctggggcccctccccttcctcttactttctgacttctttctcctttcctctttactcctctctctctcctctccccacccctgggctctcccatctccccctggggctgacgaggtccctgcccagcacctccggtcagctggcccccacgacacgatgtgccagagcagtgcccgggcccggcccccgctgatgcaccaccctgacccccgcccgtctctcccccagggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 402855 - DNA, 1855 bp, Homo sapiens
aacagagactgtggttgctgcggatggagggaccgctgatggtggctttgccttctccccggcagatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 402856 - DNA, 2765 bp, Homo sapiens
aacagagactgtggttgctgcggatggagggaccgctgatggtggctttgccttctccccggcagatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcaggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatcaccccctggtggctccctcacagcaaaaaagcctgggggcaaagaggtggcaggcacgagagatggtcacacctgcctgcagccagcacatcaacctgcaccaacccaggcaaacaccagagccctggacatggccctggagccagggtcccagcccagaaccgggggtggggaggtctctgcaccctgggacccctgcaggaatggctcaggctgtgcttgccagagcaggatgcccgggcaggcggcaacagccaccctccccagtggcagcgccttagaaacagcttgcgtattaaaatcatggtttaaaaaaaaaaaaaaaaataggcgtctcaggcagatggaggcaggggctgaggggggcccgtacctgtgctcagggcttccctgccttcctcacctgtgctttcttcttggccccactctgaagcaggctgggactcctgatgaccaaagacagccttgcctttttccgtgccagcgcggacagtggtgatttgcccaagaccccctttttgggaagagccttctgatgctgcttttggcctgcaggttccgtgggggacccgggagctccattcacctgggacggcttctggtttttcttctgcagttttggggatttggcaggggtgctggggctccgggtgggggcgccaggggctggactcttggtggttggcgtcccgtttgcctgggctgggaccttagcctttgtcctgttcctcttcttcctgcccatgc

SEQ ID NO: 402857 - DNA, 2078 bp, Homo sapiens
gccctgggcatgtggatcccgctctacctgcaccgcgcccaagttgtgcagaagacagcagagacgtgcaacagcccgccctgtggggccaaggacagcctcatctttggggccatcacctgctttacgggatttctgggcgtggtcacgggggcaggagccacgcgctggtgccgcctgaagacccagcgggccgacccactggtgtgtgccgtgggcatgctgggctctgccatcttcatctgcctgatcttcgtggctgccaagagcagcatcgtaggagcctatatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 402858 - DNA, 2330 bp, Homo sapiens
gccctgggcatgtggatcccgctctacctgcaccgcgcccaagttgtgcagaagacagcagagacgtgcaacagcccgccctgtggggccaaggacagcctcatctttggggccatcacctgctttacgggatttctgggcgtggtcacgggggcaggagccacgcgctggtgccgcctgaagacccagcgggccgacccactggtgtgtgccgtgggcatgctgggctctgccatcttcatctgcctgatcttcgtggctgccaagagcagcatcgtaggagcctatatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttgtgagtagccccggggtggggctggccgggggaggctgggggactgcaggagggctctgccctgacatccacccccaaatcctcgcagatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcaggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 402859 - DNA, 873 bp, Homo sapiens
ttcctttcctcattcaacatccccgcatttcaaggctctctaccagcatttctttgttcattgttcagaaaaaaatgaatcaagccatgactagaggcttgaattcaacctttaaaaaattgtatggctcaaagggtctctatccaagtttttcccaaaagattattctccaaggaaaaaagaaaacaaaatggctaaatcgcaacattttttcagtctccattatcccacggctctctttaccccttgagacacacaatcttcaatagtaaacagggctgaagtttgagggcaaggcctagagaagctgtttaatttctaccccaaagacaaactcagattctttcacaattttccctcaggccagccctctgctttatagggccaaaccactgaaagaacaaatgaatgcgaacaatttgcctcccagcagcgagcactaagatttcctacagatacgaattcccaagcaaaccctgcccaaagataatacaaatgaaggttgggtttatcgggctttttaaagggtggctgcctgatcttctttaggatctgaatatgtttacacggggattggcggggcgcttactgacagagcagttttagaaaacaaacacaggccccagaacactcatcagtctgcagcggctcggccgctcattccacaaatactcactgtgcatccaccatgcgcagccactgtgtgtggtgctgtgggggacagaatgacaatgtgtcttgggaggtggcctcagctataggtagggaggacagggcttctgtcccaaatggtaaatgtcatagagtgggggtgtcaccgagtgtgggggtattacagagttaggccaagaggtgggatctgaggtagacctc

SEQ ID NO: 402860 - DNA, 608 bp, Homo sapiens
atgaactgtgactccatttgaaagagagatacccagagaggccaggccttacccagagatcaaggtggcagcattggagctgggttttgacaggcacagctgcaaatgctcacaggaccagcagcattggaaaagtaatcaccagagccctccacgaagcccctgatgggatagatcggacttaagaacaacagtatcaacaaagagaattttcaggaaaagaagctctgccttgcttgtttaattaaaaaagaagatatatgggaagacattttgcagaatgcctttttagaaaggcaaaaaaaaaaaaaaagaaagaaaattcctcctacctaaagtaaaacatcaacactcttgaatagaaaagaatttagattctgaactaaatggtttaatgagggacagataataagtgtgaattgaaactaattggtgtttcagatcactgagctggttgaaaaaccatttgtgatgaggtctgtataagttaacagtcgcttttaaatgcccaattaaacatcgttctgtccctagtgagaataaaaaaatgtattgttgcttattgctctatacttaaccaaatgattaaagtgggtaatctgaacaga

SEQ ID NO: 402861 - DNA, 338 bp, Homo sapiens
  misc_feature (306)..(306): n is a, c, g, or t
  misc_feature (315)..(315): n is a, c, g, or t
gaccgtaagaattcctacttcaaaccctcagacctcaaataactgccagaactacttgactgaggtatcaacctatgttatctcctccatcagaaagcccatgatattgacataaaagtggctgttgctgtgttggacacttgctcccatctattttcttctctagaatccactgccctggaatgagtcattttttttagaagcagaggtggagccactgaggaagcacaggcgagccctccccagcgtgtactcactggtccccaacagaagaacagctgccgcatccactgaggggctcagtgnatgggcggngtccaacctctggtgctgaatca

SEQ ID NO: 402862 - DNA, 415 bp, Homo sapiens
tatcacctggagatagatggattcccagacccaccaaatctaggttttagaccaaaaaagaatgttttattattagaattgagtatatctcaggtcctctttcattactacaacacaaaataaatctgggggccaggaacggtggctcacacctgtaatcccagcactttgggaggctgaggcaggtggattgcctgagatcaggagttccagaccagtctggccaacatggtgaaaccccgtctctactaaaaatacaaaaaaaattagctgggcgtggtgatatgcccctgtaatcccagctacttgggaggctgaggcaggggaattgcttgaatcaaggaggtggaggttgcaatgagccaagatcgcgccactgcactccagcctgggtgacaaagcgagactccagcaa

SEQ ID NO: 402863 - DNA, 377 bp, Homo sapiens
cattagccaccacgcctggcctagaattcaaatcttaaaacattgctgtgttgaatttttattttatggctgacatttttgtttaatgtcatctttttcaattaaaaggagttttaaaatatataatgttgaaatcaaagtagcaagtttttgtttttttggttttttttttttgagacggattctcactctgtcgcccaggctggagtgcagtgatgtgattgtggcctcctccgcctcctgggttcaagtgatcctcctaccgcagtctcccaagtagctgggattacaagtggatgccaccacacccagctcatttttgtatttttagtagagatggggtttcaccatgttgtccaggctggtcttgaactcct

SEQ ID NO: 402864 - DNA, 1450 bp, Homo sapiens
cgttatttttgtagtgtttctgattctaaaagggccaggcttgagagtatgaggaattgagcagggttttcttctgactcaaaaataaggaggaggcccttggtaattcctataggctttaggttgagatccctaaagggttacatctcagacaaaagtaaatcagaagtaaacctggcatcagaaggactgaagcccagtttaaaatcatctcagttcccaattaggttaaaatacaatttgtagtattcttaaccacctgccaagagcaaatacaatctccaccagaagaagacatcatccaactgctaaaattatctttataatttttcatatacaggatctaacactcagtccaaaacagagagagagagagacagacagagacataaagacatacatggaggcaaaccagcatgaataaaaaccacgagaaatgtggccgggcatggtggctcacgtctgtaatcccagcactttagggggctgaggcaggtggatcacttgaggtcaggagttcaagaccagcctggtcaacatggtgaaaccccatctttactaaaaatacaaaaattagctgggcttggtggcacatgcctgtaatcccagctatacaagaggctgagggaggagaattgcttgaacccaggaggcggaggttgcagtgagctgagtttgtaccactgcactgcagcctgagtgacagagtgagattgcgtctcaacaacaacaacaaaatatcccaagagaaatgagataataataccacagtggatccagccaatgatattagcactagacatggactggaaactaaccatgctttcaagaaattttaaaaaataaggtgcaatatttttattaaagaactacaaattacttttaaaaatcccaaattggggaaaacctagaactaaaaagtactgtgaaattgaaaagacacagatggtttttaatagtaagatacaggttagtaaaattagtaaattggaagatagaccagaagaaaatactgagcctaatgaatgaagataagaaagagacttatactctaagagcatagtaaaaaggtctaacatgtgccataggaattttggaaagatgtgtatgagagacgtagaataagttagaagccgtgtttgaagacataatggttgagaatgttccaaaactgtcaaaacaaaaaaacaaacccaacaagcatacatttgaaaagctctttaagaatccaaggcatgttaaatacaaagatatttatacctagaaaattatactaaaccaaagacaatgaaaaaagtctaaaaagcagctagaggaaaccagagactacagttgctccttgccaagctgaaaatattttaagtcaaaaatgcatttaatgcatctaaactaccaagcatcataacttgacatagcctaccttaaatgtgcaggacattaaatgtgctca

SEQ ID NO: 402865 - DNA, 401 bp, Homo sapiens
ggatttcaggatttatttgaagtgagctctgtcagtatgcaggtacccttaccaccccaaggaaaaggctaaagccaagagactgtgactggagctgcctttgtcagcaaggagaaagaagatccaatgggcttgtactaatgtcaggggcacgtgtccctctgccggccacgtgcaccttagaaagaagtcagcctggaccaattcaagagatcctgcctaagatgactgcctggaagtgccgagcacccccgacagagtggaccactgaagctagggatgagaaagggagtccttaatggtcaggtagaggatagccttagaaactgcagtgagaagaccacagaggaaagagctaaaaaaatccaagaattctgttgggagaagggaatctcacaaga

SEQ ID NO: 402866 - DNA, 286 bp, Homo sapiens
gggcagcacaccacagcatctgctacagtcaacctctttcacaactcaggttcactggcttcaaataataagtttatgacacctaggcatagaaccctagatgtctgctattttcccatcatggggaatacgaagtgaccaggtggcaaccgtagcttaaatttaatgggatgcttgccatagaccctggtaacagtatttcccctctgtgaaccaggaccccaaaacttcgcaagttttgggggacagaaaatgcaaattcccaagcaagtcactgggactgatg

SEQ ID NO: 402867 - DNA, 894 bp, Homo sapiens
ttttgttcttttgaaagagacagccttgctatcttgcctaggctggtcttgaactcctggcctcaagtgatcctccagccttagcctcccaaatagctgggattacaggcatgagccaatgcacacagcctagtgactcgtttctaacaaacagagcatagcccaagtgatggaatgttactgccacaattagattattaatggctatgacttctgtcttgctagtactctttttcttactggcagtctctcttgtcctctcgatgaagctagttgccatgttgtgagatgctctatggggagcttcgtgtgacaaggaactgaggaagaccttcaaccaacatctggtgaggaactgaggcctcagttcaagagctcagaaggaactgactcctgccaacaaccacatgagtgagctgggaagcagatttttcccagctgagccctgacgtgatggcagccttttgagaaccacaggaccctgctaagccaagctcagattctcgacctacagaaactatgaaataataaatattgtcttaggccactgatttctgggttaaactgttatgcagcaataaacaaatacaccaactaaagaaaaagtttctttaaagaattaaagaagatttgttgttgttgctgcatttaatgttttgaagattcttgctgtaactggataagatgagcatttatttcagttatcatagaaacaaactcagtgcaatgactgggatgactaaaagatggccataagagaggagacaggctgtattccacgtccaattcccagtgaatacaacaacaaaagaattattatttcagtagtactagcacttcctttcttagctaccatggatcagcttgcagcacaccaaccctcttgcaatgaac

SEQ ID NO: 402868 - DNA, 841 bp, Homo sapiens
ttttgttcttttgaaagagacagccttgctatcttgcctaggctggtcttgaactcctggcctcaagtgatcctccagccttagcctcccaaatagctgggattacaggcatgagccaatgcacacagcctagtgactcgtttctaacaaacagagcatagcccaagtgatggaatgttactgccacaattagattattaatggctatgacttctgtcttgctagtactctttttcttactggcagtctctcttgtcctctcgatgaagctagttgccatgttgtgagatgctctatggggagcttcgtgtgacaaggaactgaggaagaccttcaaccaacatctggtgaggaactgaggcctcagttcaagagctcagaaggaactgactcctgccaacaaccacatgagtgagctgggaagcagatttttcccagctgagccctgacgtgatggcagccttttgagaaccacaggaccctgctaagccaagctcagattctcgacctacagaaactatgaaataataaatattgtcttaggccactgatttctgggttaaactgttatgcagcaataaacaaatacaccaactaaagaaaaagaagattcttgctgtaactggataagatgagcatttatttcagttatcatagaaacaaactcagtgcaatgactgggatgactaaaagatggccataagagaggagacaggctgtattccacgtccaattcccagtgaatacaacaacaaaagaattattatttcagtagtactagcacttcctttcttagctaccatggatcagcttgcagcacaccaaccctcttgcaatgaac

SEQ ID NO: 402869 - DNA, 386 bp, Homo sapiens
gtatcttcagggtagattttataagtgagattatagggctccttatgtagttatattaggtattgccaagtttcccttgagaagggttgtagcagtttgtattccttaacagcaatgaaaagagtgattattttcctaagatctggctaacaaaatgtgttgtcatattttaatttattacattttattagttaaaattttaatttttacccatctgataggtgagaaataatagcttagcatttttttaatctgcatttttctagttatgaacttgcactttacaggtatatatatgtatttttctttttaaaaaattgtattttaagttctggggtacatgtgcaggacatgcaggtttattacgtaggtaaatgtgtgccacg

SEQ ID NO: 402870 - DNA, 512 bp, Homo sapiens
acaggttgtacttctccatatgtgagactactggaagtgagaagcaatatttgtcatttctaaaactggccaggctgtgctgacccaggattagtaatttgttatgtctgttttcccttagatgtttgggcactcagatgctatcttggtgcacacacacaacattgctgttcagtcacaaatccgaacaacttaatataataaattgtactaaaagtcatttaagaaataccaaaaagtaagcttttgtttctaaccattgttataaaggctaatataattgttgttatatagcagtaagatatatttgtgtgcatgcgtctccaagtcagttgtaaatgtcttgagaacagagaatacaattgtcatctttatattgcctcatttctccactaatacttagcaaataaaaggcaataagtaaatatgtactggttgaatgcctctggagacctagagtttaaagttttaagtcaataaataaataaatatttactcttaaataaatagaa

SEQ ID NO: 402871 - DNA, 576 bp, Homo sapiens
gcctcccgggcatcccccgtcccaccctcacccagtcaaaccaccacgttcccaaatgtaaagcaacccaccgagcgcccatggagcaaggtttagggccaggcttcgagccagctgaggcacaccacctaacagacgctgaggtccatagagccgacagaactccctaaggcaggtggccctgccccggcccatctcccaccccacactgtgtacctcccagcaggcctcacgctcctcctctacaattcagctccagaccctaggcatgacttcccgtacctcctgcccagcccaagccacagctctgcagggacacagaggagccctgggctcctgcccaacctgccacaaccagcgacgatggacccgagccagcccacagccccgacctgagaaacatctgtaaaatgggacagcaccatcacggctgctgggagaccacacaccccaacaccaaccctggttcttggaaatcaatccaggttggagcttcacaacgagcaaagccagcagaggacaagcaggctggctctggaccgcactcacaaaggtagctaaagcaaggcggccgct

SEQ ID NO: 402872 - DNA, 390 bp, Homo sapiens
ctccagagtagctgggattacagtcatgtgcccctgccaagctcatggctgggtgtggtggctcgtgcctgtaatcacagcactttgggaggccaaggcaggtggatcccttgagctcaggaatttgagaccagcctgggcaacatagtgaaaccccaccttcaaaaaaaaaaacaaaagatctgaaggtcatactccttcctcacactccattggcatataatatattttttggagggagagatactattgagattttcaggttctagggctcagttgaaatatccctcaccaggacttagtgctcttagaacctggaagtttcaaaaaggaaaaataaaaaaataaaaagtaatatttttaaaaagataaattaaaataaatagtaaa

SEQ ID NO: 402873 - DNA, 800 bp, Homo sapiens
gatcatcgtcatgaaactcatcatcaaatggcatttgagcaaaatctttattaattaaacatgagtggaagtttaaaggccaaagcacaactcactcaggcattgtgaactatgtgtgcagacagatcacaactcatccttggtctctgggtgtgtctgcgtctattactgacttaccctggatatgtaaaatgagtaagaaaaactttttgtgttagccactgggatttttggtttgtgtattactttagcatattatctcattttgaatgctatagtttaggacactagtttaaactactgaagttaaaatgttctccttatttcagaggagagaaggatcttacagtgacagacatccattagtaagaattaatttctagagataaagtgaattcagtaaccacagtgtcagtagagtcagcatggtcaaaatagtctacatgggaaatgtttggtggctcttagttgatcatggagtctctagaaccaaaagttatgaatgccaattaagtttcgatttggcttatatgatctcaaatcttcaggtttacaaaacatatcttgagccaccacccagctctgtcacccaggctggagtgcagtggcaccatctcagctcattgcagcctccgcctccgaggtttaagcgattctcatgcctcagcctcctgagtaactgggactacaggtgctcaccaccatgcagggatgttttttctatttttttggagagacacggtttcaccatgttggccaggctgctctcgaactccttacctcatgatccgcccacctcg

SEQ ID NO: 402874 - DNA, 688 bp, Homo sapiens
ttttgaaaggcggcttctcaccatgttgctcaggctggtctcaaactcctgggctcaagtgatcctcctgcatcggcctctcaaagtgctgggattacaacaggtgcaagccaccgccctggcctttgtttacttatttattaaagattactctagaatgcatgcttggaatattgcctgtatcatatcatatgtgttgctaaataaagctacccatttcataactacacaaaatgattaggaagtttccatcgtgttctttactctgtgttctttctccactaatatttgatcttcttcctcctcttttgacaaactcacaatagattatcagcccttctaatgatcaagggtctgtcggcctctttcttattcgttccaatgagagctggtgacagcatcaatcttgcgtcacacagctccatgaagtatctgcctgccttcatctctgtatctcattaatggaactgttgatgggaaggagtgaaatgatgctcaaagctggcattagcacagccgactcccagactgtctctttgtgagcctggcagctttgttcacaccatgaccccacgctacaggtgcgtttcatgattccttctgcagtggtcatgatccatttaattgaaaatatttcttcctgggtggtacttgctagaaaggcttcacaaacccaggacacagtatg

SEQ ID NO: 402875 - DNA, 312 bp, Homo sapiens
aaggaactccaacaaaccaattaacctctttcgatttggtgcaactggaaaaatgacatccacgtaagcaagacccagagacagtaagcctggcacttagtaggttttcgattaacactagcaaccatgatgatatgtgattattaggccccaaaatggcccgtggctgaagccaccagtgactgtgggatactttctccagcaacatcactaccaccctcttaaagcacccacgccaacttagttgacagaagttaagcctattacattgaaccgctttacatcttccaataaaagtaccttaggagcatg

SEQ ID NO: 402876 - DNA, 454 bp, Homo sapiens
cctcagtaaatatgtgctgtattacatgtgtatatatgggtttgtatgtgtgtgtattcattcccaaaaagaattctaagtaggaagcatcaaaatcacaaaaatcactgggtacatttgggaactaattcatccaatttatagcgtgatctaatacaatgattctcaaaatttagtgtgttaaataatctcaacaagcttggaaaaatgaagattgaagcttagtctagaattttggttctgtatctctaaagaaaccttcatttttatggctggtctgaggactgtacctggatgatataaacaaataatttaacttctaaaaaaattaatgctcaagcatggtggctggcacctataatcctagcacttcgggaggctgaggcaggaatatcacttcagctcaggggtttgagaccagcctggggagcatagtgatactttgtctctacca

SEQ ID NO: 402877 - DNA, 286 bp, Homo sapiens
ctttttttcttttggatgaaaggcaatttcattacacaataataaacttctttgccaaagctttatttggaagcagggggaaagggaagggaaattttattaaatggtaaacctatcagtaattagaaataatactttaacctcaaaagaaatactaaagcctctaccagcacttaaaatctgcaaaataactgtgcccactaaaaattctagttcttccttttatgaatatatctgcagctattccatatttcaaaacaataaattctatatgaaatgctctatg

SEQ ID NO: 402878 - DNA, 704 bp, Homo sapiens
gcacatttagttcatcatagaaagtctgaaatactggttctagagagagtttatgaacctcctcttttactacgatatttactctaggatctagtccttttctatccatgcccagagatatgtgttctctttttttctaccttgggtttaagggatttgtaattactaattttaaggggttgcagcttccactcatacaggcggggctgccttctcctttttggagctaaacaggattttttcatcctttttccaagtagtccagatgacacaagaccagtaattacacacagttgcacatgagcttaattcatggcagatatacttatttcctgccgtgtaacttttttttttcaatttaaagaaccacatcttatcctatgccgattgctattgatagtggcacaagcattaagttttagggttatatgcttggggacccatctttcttctgtcttagctgttactttacttgcgtcgcctagaaaatgaccagtccttaattttattctaaaaactgtgatcatgggaggcttaaaatgggtcataacaggcatcaggttggttatttcctgagctacataccttggatagaatagcattatacaaacaagtttcttttagagtcccggtacacttataataaccataaaataacaggactgtagcaatcttttgtcctaccttagtgacttgatgtatat

SEQ ID NO: 402879 - DNA, 461 bp, Homo sapiens
tcgctctgtcacccaggctggagtgcagtggcgcgatctcggctcactgcaagctccgccacctgggttcacgccattctcctgcctcagcctcccgagtagctgggactacaggtgctgggctttctgccacttgaatcctgtttcttatcacccgtgtttggtctgtgtttatgagtctttctccaaatgtcatctgtccgtactgcatggtttctacagaagaccttggtgccttccaatatgcccaccactaaaatgctgggtgaggctttgctgatttcctcacccttactcctcatggttttccccagaccatgaccaggaagtatgcaatggtcacactctgcgagccctcaaaggaggaagtcatttgttcaagttggggttgcaaactccagagctgccatagtttctggcggtgtgtggtaattttcccttgtcattaaatgacatatgta

SEQ ID NO: 402880 - DNA, 527 bp, Homo sapiens
  misc_feature (1)..(1): n is a, c, g, or t
  misc_feature (14)..(14): n is a, c, g, or t
  misc_feature (19)..(19): n is a, c, g, or t
  misc_feature (504)..(504): n is a, c, g, or t
  misc_feature (508)..(508): n is a, c, g, or t
  misc_feature (513)..(513): n is a, c, g, or t
  misc_feature (518)..(518): n is a, c, g, or t
  misc_feature (520)..(520): n is a, c, g, or t
naaacacctttcanggtancttaattccccttaacctaagtccaccctcagcagatgataatatcaatacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgctatccgtcggggatcctctagaggggacaacaggcatgcaagcaggcacggnggtntcaangagtncntgtagac

SEQ ID NO: 402881 - DNA, 1568 bp, Homo sapiens
  misc_feature (1545)..(1545): n is a, c, g, or t
  misc_feature (1549)..(1549): n is a, c, g, or t
  misc_feature (1554)..(1554): n is a, c, g, or t
  misc_feature (1559)..(1559): n is a, c, g, or t
  misc_feature (1561)..(1561): n is a, c, g, or t
atggagacccagtgctgaggtccttgtatgcacacaaagaaaagagtttcttcctttcgaggaaatacaatgtcctgaaagacgtcattactctacggagacatgtggaaacacaaagttagagctaaaatccgtaagaggaaggtgacaacgaaaatcaaccatcatgacaaaatcaatggaaagaggaagagcgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaatacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgctatccgtcggggatcctctagaggggacaacaggcatgcaagcaggcacggnggtntcaangagtncntgtagac

SEQ ID NO: 402882 - DNA, 1152 bp, Homo sapiens
  misc_feature (1091)..(1091): n is a, c, g, or t
  misc_feature (1096)..(1097): n is a, c, g, or t
  misc_feature (1143)..(1143): n is a, c, g, or t
atggagacccagtgctgaggtccttgtatgcacacaaagaaaagagtttcttcctttcgaggaaatacaatgtcctgaaagacgtcattactctacggagacatgtggaaacacaaagttagagctaaaatccgtaagaggaaggtgacaacgaaaatcaaccatcatgacaaaatcaatggaaagaggaagagcgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgaataaattttaaaagaaaacctttttcgagncggtnnaggtttaactttccccttttccaccccttcaactaggattgatttnatattttaa

SEQ ID NO: 402883 - DNA, 1071 bp, Homo sapiens
  misc_feature (65)..(65): n is a, c, g, or t
  misc_feature (96)..(96): n is a, c, g, or t
  misc_feature (1048)..(1048): n is a, c, g, or t
  misc_feature (1052)..(1052): n is a, c, g, or t
  misc_feature (1057)..(1057): n is a, c, g, or t
  misc_feature (1062)..(1062): n is a, c, g, or t
  misc_feature (1064)..(1064): n is a, c, g, or t
agaggatccgagcagatctcagaaggtctgtggtagacgcattacatttgagacgctctgtctgnatctcaggccaacacgacttcctcaagcatnctccaaaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaatacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgctatccgtcggggatcctctagaggggacaacaggcatgcaagcaggcacggnggtntcaangagtncntgtagac

SEQ ID NO: 402884 - DNA, 1454 bp, Homo sapiens
  misc_feature (1431)..(1431): n is a, c, g, or t
  misc_feature (1435)..(1435): n is a, c, g, or t
  misc_feature (1440)..(1440): n is a, c, g, or t
  misc_feature (1445)..(1445): n is a, c, g, or t
  misc_feature (1447)..(1447): n is a, c, g, or t
atggagacccagtgctgaggtccttgtatgcacacaaagaaaagagtttcttcctttcgaggaaatacaatgtcctgaaagacgtcattactctacggagacatgtggaaacacaaagttagagctaaaatccgtaagaggaaggtgacaacgaaaatcaaccatcatgacaaaatcaatggaaagaggaagagcgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactgcccttccaccctcagcagatgataatatcaatacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgatctcaagacaccttccgagcgtcagctcactccccttccaccctcagctccaccctcagcagatgataatatcaagatacctgctgagcgtctgcggattccgctatccgtcggggatcctctagaggggacaacaggcatgcaagcaggcacggnggtntcaangagtncntgtagac

SEQ ID NO: 402885 - DNA, 994 bp, Homo sapiens
atggagacccagtgctgaggtccttgtatgcacacaaagaaaagagtttcttcctttcgaggaaatacaatgtcctgaaagacgtcattactctacggagacatgtggaaacacaaagttagagctaaaatccgtaagaggaaggtgacaacgaaaatcaaccatcatgacaaaatcaatggaaagaggaagagcgccagaaaacagaaaatgtttcaacgtgcgcaagagttgcggcggcgagcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcccgagtgtctactcactccccttccaccctcagctctaccctcagctccaccctcagcggatgataatctcaagacacgtgccgagtgtctgctccatccccttccaccctcagcggatgataatctcaagacaccttccgagcgtcagctcactcccctccgaagcggctgccgcatccgaagcagttgccgcaccatagtctaatagaaaacaaccgaaaccaaataattcaagcactgcttattacaattttactggggtctctattttaccctcctacaagcctcagagtacttcgagtctc

SEQ ID NO: 402886 - DNA, 149 bp, Homo sapiens
cctcctgtctcaaaaggcaccagagtcttctcagaaaagccttcctgcttgatccagtgacaaccaccacctcctgggcactcgatgccacctccatgcctccttcaggacgtggggatccattatcccatcttgcttcaaaatcttta

SEQ ID NO: 402887 - DNA, 805 bp, Homo sapiens
ccagattcaccactgttaacatgatgccatacttgctctgatgttttttctgttccttctgtacaagtgtgcacacacacctatacacacatacatacatacatacacatatgtttttcatgaactgtttgagtggaggcctcagattacactttattttgaagataaacagaatcttctgggagattggttgtgtggtatgagagaaagtgagaattcaagaatgacgcttgggttttagcctaggcagttagacagaaggagttgcccttgagtgggttgaggaagcgtgagggaggagcaaacctggggagaagtccaggattttgattttggtcatgtgaatctggaggtatctattagatatctatgcagaggagtgctgtaggcagctggataggtgaatgcacagttcagggaggaggtgtggacttggcagttgttggtgaatagatagtgtgtaaagcctcgagacggtgcgagatctcaaagagagtgagggtaagtagaggaaacatctgaggatggaggcttgagacagcctcgtatgagaggttatggaattgaggaggagctgataaaggaggctgtgaaggagataggtgagtgaggaggccaagagaagaagacattcatcgttggctgtgtcactactcacagtccatgtagcaacatgcaagtcattcggtgtctgccaagagcagtttgggtggaaggtcttaagacaaaatggaggagagaagttgcaatgtgggaactctcgagaggtttgttataaaagagaggtccagaaaaagagaatagt

SEQ ID NO: 402888 - DNA, 2947 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402889 - DNA, 653 bp, Homo sapiens
agtatattaagtgcaacaggtacatgccatgagccatattaccgattggagccccaaggtctggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402890 - DNA, 413 bp, Homo sapiens
ggaattctcctcacccccacccctgtacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402891 - DNA, 559 bp, Homo sapiens
  misc_feature (468)..(468): n is a, c, g, or t
  misc_feature (473)..(473): n is a, c, g, or t
tccatcgtgatagctgactcttgaggataaaccgacgcagaggatcctaagtaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagcttgngactntacttggatcctggcactgctctcgggtgaggttgaccactgtgccagtcaaaattgccaagcatactgtacaaacataagtgtgt

SEQ ID NO: 402892 - DNA, 374 bp, Homo sapiens
  misc_feature (341)..(341): n is a, c, g, or t
atttttagtagagatgggtttcaccatgttggtcaggctagtcttaaactcctgacctcaggtgatccacctttcttggcctcccaaagtgctgggattataggcgtgagccactgcacccggccaggaggcctttcttcacagatagtttgagtaggtgttcattctggagagcccctgtggatcccagaactctttcacagcttcaactcccggctggcattccccatctggcacagctgggatgagtcagtctaatgtaccgagctcctgtcacaagtcagtaatgtaagtgccgcaagggaaccaaagccatgggccctcctttctgccttcatggngagacgtctgtaggctggagagatgttgccctg

SEQ ID NO: 402893 - DNA, 276 bp, Homo sapiens
catcgacatggagatagcccagagtgttctccggtgcagcgtagagaacagtttgacgtcagttgatcgagctagagacaggtggccttaagaacttcattagagctttggatgcacacagatcctgtttctcagaaaaatgagtctgtacggaaccagggaggatctcctggcactgggaatgaaaaagaacggttcttttcattgcagggttatagcatttgcacttttattttccagatatcctgagggtgcattttggaaatgaattttaag

SEQ ID NO: 402894 - DNA, 3368 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccaaaaaaaaaaacaggggaggagaggctattggagttgtcccaccgaagggggaccccagtgcatttcagcaggtacccagcttgttgttgtagcaaaaggggtccccctaaatatgtggagcctcgtacatactacaggctagggcacattgtccggtggagggttgaccacgccggtcgcgaccctggtgacaaccctggatagctaggggaacatcattgggtaaaggggtaaccttacttatcgctgcttgtgacagttaatgtgtcactaattgcaccgtaccctgagatttacagtgctctagatggagcagtataagatttttacgggtgtatcacgcgtcgtagactcgctgaatctcgtggcatgaagagaaatatggaaccggactagtgtcgtggagcatgtgtacacggac

SEQ ID NO: 402895 - DNA, 2855 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402896 - DNA, 2625 bp, Homo sapiens
gctacagtgggtattgactgatggccctcctctttctctactacgtggataaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402897 - DNA, 3132 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggcctcttcctggacttcgagcctgaccctctcccactttgtccagatgtctcgtttttcccacaaccccagccacccaccccacagtcgaaaggaacaggtgtgaaagttagctttcttcctcgcgtttagactttttgagacgaaagcaatcttgttctgtgggtgctgtgcggcgcttaaaaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402898 - DNA, 3107 bp, Homo sapiens
tgtgggcacacaaatgacctgctgatgttaaattaactgacccgtgtatgtcataaggtttctctcaattctgttcacactcttggaaaaatgcctcagaaagttttcttagcccagcacctgtgtattaaccaattagtaatatacatacaggatatacaagcagaagtgtgatcacctgtgcaaccagaatctggcaaatctaaggtcaaacacctttcctttgaccaagttttctctcttttagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402899 - DNA, 3010 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccaggcagaatgtcaggctgtctgataccttcctgtgttccttcatggaattcctttcctattccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402900 - DNA, 2892 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaacttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402901 - DNA, 2971 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
  misc_feature (2951)..(2951): n is a, c, g, or t
  misc_feature (2953)..(2954): n is a, c, g, or t
  misc_feature (2958)..(2958): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccaaaanannaganaaaaagagaagac

SEQ ID NO: 402902 - DNA, 2049 bp, Homo sapiens
ggatcctctagagacgcagctcatccaaagcacttcaacatcaaccagaaatcgtctgtgaccccctgtctgattacaatgtgtggagcatgctaaagcctataaatacaactgggacattaaagcctgacgacagggttgtggttgctgccacccggctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402903 - DNA, 3178 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatgtgagtggtggtgggtgttggaagtgccctggggcccctttcccttgggaaagttggaggttcttctagacctagttagacccaggggattgggatggagaggtggagagatgcagtcctcagcaattgggtgttgaaaagcctgggtgaaaatggaccatctgaagggtaaagggacagcagccagttagctcaattggttagagcatggcactgatagagggtagagggaacgagtgagaagaggatcaccctagccgtgtgttgtggcgcatcttctgtgcagctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaacttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402904 - DNA, 2674 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtaccgtctcctcaggggatcctctagagtcg

SEQ ID NO: 402905 - DNA, 1388 bp, Homo sapiens
cccacgcgtccggaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402906 - DNA, 1913 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccagctggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402907 - DNA, 1113 bp, Homo sapiens
gggtcgtatgcatagatttgcacatggtgggctggtatgtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402908 - DNA, 2396 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcaccatctctgagtcccacagtcgaagggatcctcaagagcagc

SEQ ID NO: 402909 - DNA, 997 bp, Homo sapiens
gatggctacggagggggtggctctgatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402910 - DNA, 995 bp, Homo sapiens
ctcatttcagttcacttcctagagcatctgtgcccactgggacacaaccactaatttgtcactgaacctcctgggcctgtctcagattgggattaacataaaagagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402911 - DNA, 1365 bp, Homo sapiens
atttttagtagagatgggtttcaccatgttggtcaggctagtcttaaactcctgacctcaggtgatccacctttcttggcctcccaaagtgctgggattataggcgtgagccactgcacccggccaggaggcctttcttcacagatagtttgagtaggtgttcattctggagagcccctgtggatcccagaactctttcacagcttcaactcccggctggcattccccatctggcacagctgggatgagtcagtctaatgtaccgagctcctgtcacaagtcagtaatgtaagtgccgcaagggaaccaaagccatgggccctcctttcaaaatgcctaaaatctaagtaatacaagatggaagcaagaacagagatgctttacttctcttttcaaatggggagacaaagtctgtaggctggagagatgttgcccatgattattccatagttggtgcttagagccagcatccgaattcccatggctccaaaccccaaacagttatccaaaaaactgcactgagttctgagaatgcctttgtcctttcctgccctccctccccctgcttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402912 - DNA, 1349 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccagctcaggtggtgtgggtccgagctcgattg

SEQ ID NO: 402913 - DNA, 1653 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccagggcctgtgagacagggtaagagacaggattggattgggtgttggccaaaggatgaacaccacagctgttgttgctgctgggaagaatcaggaactcagtgacattccattggttccctggactgggtagttctctgatcatttgttgcctagcagactaccactgcccattaaggataggtgagtgactagctcccttcttgccttgctgccccatggatccaattgtcaaggctgctctacccaagtcctggctgtgtcacactcgctgcccaacttgtcctccactttcctcattgcttgttcaaaaccttcccttccctctaggtccacc

SEQ ID NO: 402914 - DNA, 547 bp, Homo sapiens
caacaccctaggctcactaaacattctactactcactctacatatttaccacaacacaatgggtcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402915 - DNA, 924 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctccaaagttcacaccacatggtgaccaaagaacactgccttcacctggccacatcagaaaagcgattcacggtgcacacacacctgtctcagctta

SEQ ID NO: 402916 - DNA, 800 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtgtgagttgagatggattcatgtttgtggacattgatatttgtctgtgccctagatactaagtaacatccatgtcctgcttaggagatttgacacttatattggactgtatgtaggcagttacagataaccgtctgtcaagctaggcaagataattaataagaactaacatttagtaaatgctgcataccaagctttttacatgtgcatctcatacaaccccaaccacaaccccacaaaataggtcttactgttattgtcactttataaatgatgaaactaaaacttaaagaagttgagtaactttcccaagatcatactggtaataagtgatgatgccaggatctggtggcccgagcactaagctgagagaccttttttttttgacacggagtttcactcttgtcccccaggctgagattgtgccaccatactccagtataggtgacagagtgagacactgtctgaaaa

SEQ ID NO: 402917 - DNA, 419 bp, Homo sapiens
ggagcatgctaaagcctataaatacaactgggacattaaagcctgacgacagggttgtggttgctgccacccgggtgagtgttggcttctgatcaggatgggcagggctggcacaaaaagagctggtaggccccgctctagcatatcagatttcaaagttgctaaattgggaagcctcaaatggggaggaatctgggctgtgggactcctgggttgtctccattgccacaggacaggtatattctcttgactggagcaagaaaggaggtttggggccagttttaaagtatatatcccctgacttttcttctgttgtacctagctggatagtcgttcctttttctggaatgtggccccaggggctgaaagcgcagtggcttcctttgtcacccagctggctgctgctgaagctttgcaaa

SEQ ID NO: 402918 - DNA, 388 bp, Homo sapiens
tttccattgcccttctttctggctgctgccaatcttgggcttttcctatttcacccaccatccacccaccaaatcttcccttccctttggtctgcactcaggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtccccgccgccgtccccgcccgcggccggacag

SEQ ID NO: 402919 - DNA, 3126 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccagggcctgtgagacagggtaagagacaggattggattgggtgttggccaaaggatgaacaccacagctgttgttgctgctgggaagaatcaggaactcagtgacattccattggttccctggactgggtagttctctgatcatttgttgcctagcagactaccactgcccattaaggataggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402920 - DNA, 3233 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatgtgagtggtggtgggtgttggaagtgccctggggcccctttcccttgggaaagttggaggttcttctagacctagttagacccaggggattgggatggagaggtggagagatgcagtcctcagcaattgggtgttgaaaagcctgggtgaaaatggaccatctgaagggtaaagggacagcagccagttagctcaattggttagagcatggcactgatagagggtagagggaacgagtgagaagaggatcaccctagccgtgtgttgtggcgcatcttctgtgcagctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402921 - DNA, 3046 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggcctcttcctggacttcgagcctgaccctctcccactttgtccagatgtctcgtttttcccacaaccccagccacccaccccacagtcgaaaggaacaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402922 - DNA, 3086 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402923 - DNA, 2862 bp, Homo sapiens
tctcccccgcagcacgtcgtgtcgcttcactcccttctctaggcctcttcctggacttcgagcctgaccctctcccactttgtccagatgtctcgtttttcccacaaccccagccacccaccccacagtcgaaaggaacaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402924 - DNA, 2734 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402925 - DNA, 2533 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402926 - DNA, 2929 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgcctcaagttttgtggtttaaaaaccccccccttttcttttttttttacccccccttttaaaaaaattttttttttaaatatatatataatga

SEQ ID NO: 402927 - DNA, 2860 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttcagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402928 - DNA, 2638 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctacttttccgccgccccctcggccgattaacaccggctcgacctagc

SEQ ID NO: 402929 - DNA, 1268 bp, Homo sapiens
tttccattgcccttctttctggctgctgccaatcttgggcttttcctatttcacccaccatccacccaccaaatcttcccttccctttggtctgcactcaggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402930 - DNA, 1077 bp, Homo sapiens
atacaatcgagctcgtacccagcagcatagatattaccgtgtgttgtggcgcatcttctgtgcagctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402931 - DNA, 1000 bp, Homo sapiens
tcgagctcggctacccttaatttgcaggatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatccca

SEQ ID NO: 402932 - DNA, 2008 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcacaggtccagggcagaggaccagtcgacgcggccgcgaatttagtagtagtagtcgacc

SEQ ID NO: 402933 - DNA, 1362 bp, Homo sapiens
  misc_feature (3)..(3): n is a, c, g, or t
  misc_feature (7)..(8): n is a, c, g, or t
  misc_feature (12)..(12): n is a, c, g, or t
  misc_feature (14)..(16): n is a, c, g, or t
  misc_feature (1271)..(1271): n is a, c, g, or t
  misc_feature (1276)..(1276): n is a, c, g, or t
tcngcgnnttcngnnngcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagcttgngactntacttggatcctggcactgctctcgggtgaggttgaccactgtgccagtcaaaattgccaagcatactgtacaaacataagtgtgt

SEQ ID NO: 402934 - DNA, 439 bp, Homo sapiens
ccaactgaaagattcttctgccgtcacctggttcctaagtacttggtgtcccagtaaccagtccccctattccccatccttcccttcaggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggtaatgacactgccagctcctagcaattccagttagaaagaagattatttttctagccaggtgtggtggtgtgtgcacgtagtcccagccacccgggaggctgagacaggaggatcacttgaggccgggaggcagaggtttcagtgagctgagatggcaccattgcactccagcctgggtgacagagcaaggccctgtgtcaca

SEQ ID NO: 402935 - DNA, 541 bp, Homo sapiens
ccagaagccagtggccagtagaactctcatccagcacaccgcgtcagcagcttggaacaagcaacagaaaccaaacacacagtggaaaatcccagaacccttcagcctcagtgcagcacagcctgacccccgacatgctggaaacgagacgtcctttctccaggaggtgaagcggctcattccttcctacagaacctccaagcctttagcaaactctgatgtgaaccaaataaaccaaacagacaagcgaaaggcttctcttggagagatgtaagaaatgaggtgggtctggtgtactttcctgcttcccaggcacaaagcaaaagtatgtttgagaatttcctatgacttatgctcagaaactcgactttcctgagttagggaactgtcgagcctaatctcacccactgtttctcactggtccttacctggtagttataattactcttagcacctggtattttctcttaaagcttttcctcatgagcactggatgttcaggtttcttcagtctcccttatctgttttggactcttcttta

SEQ ID NO: 402936 - DNA, 626 bp, Homo sapiens
attcttgctgttgaattgattcttagtgtttatttgcaaaacctcaaatgtgtatctaaagtcttgaatgctttctcatagttattcattgtatactcagtagatatgaaatatcaattttacaggctaccaaaatggtatttaatggtggctgacaggatagtgtttaaggacaatatgtattggatacttaaatttttctattacctgattcttggcacagatcattgaatttaagttatactgagattgcagaagatctgcctgcctcaataaccccagctatgctgcatgtttatttagtcctggttccttcctgtgccttctgctttctaagcatgtacagaagaaaataaaacaattatttggtttctaccttaacatctgcttgcatcaggaaagatgtctaaaaaaaatttgagggacatttttgcggacacttcctgaagcctggaccagttttatgtgatttgttgacatcctttttttttttctttacccttttctaatgcctgcttcttcaattatccttaaagacccagggttttaccacactgcaacttaaaatttgagggtaaatttggtaaatcttgagctccttaaaagatgatctgttttatacccat

SEQ ID NO: 402937 - DNA, 426 bp, Homo sapiens
ggaggatttgcaggatccatttagaaagatcctcccttacttccacaagcatggcctttggctcttaaatacctgtgctggggttttgtaattatagaaacaacaggaaccaaaactcattaatgttgagctacaaaccagagggaagcttctttctcaaaacagggctcaggcctagaaaaatctagttttctgaaatcgctagccagcaacagcactgagatggccatcccagaaacaaggccaacacagaagcacccataaaggctgctggaggttgggacaaagagatccttgctgtccttacagaccccctgacttccaaggagctcccctctcacccagcctggcctgccttctccacagggtagctgatcgtcagcatcatcttcaatggtgttgtcaagagcactcagtgctcctgcc

SEQ ID NO: 402938 - DNA, 462 bp, Homo sapiens
ggacgacagagatgaagtctaatattgagggtggcattgctgtctggaaacatgggacacgtggaaggacaggtattccctttatgtgtcaacttgtctcctcttctcctctaaaacttgaccagactaatagcccaccaacagagctgtggtccagcatctactcagaccaaaaagctacagcatctataagttgtctaaattatctggtctagaatttcaggtctcccacatctgtcaccttcccttacataccttgtgacccagctaccttgtaggacttgctcctccctgtaggtacccttgtggatccccaacacatatgtcctttttattagtctgttctcatgctgcttataaagacacacctgagaccgggcaatttatgaagaaaaagaggtttaagggatgtacagttccacgtggctggggaggtttcaccttctgccatgattgtgtggc

SEQ ID NO: 402939 - DNA, 348 bp, Homo sapiens
ctcagcctcccagttagctgggacttcaggtgcatgacaccatacctggctaaattttttgtagagacagagttttgccatgttgcccatgctggcttcgaactcctggactcaagtgatccacctgcttcagcctcccaaaaggctcggattacaggtgtgagccaccgcaccccgcctgatgttaaaacttaatctccaatgtggcagtattgatagatggcgtctttaagaggtgattgggtcatgaggattctgcactcatgaataaattaattcatggatctattggttaatagatgaatgggttatcataggagtggaaatagtgactttataagaagagga

SEQ ID NO: 402940 - DNA, 529 bp, Homo sapiens
gagatgcctgttgaactggaaagaaaagccaccaattcgtgatgccctgaaatgctcctgtgggtggcagcaggtggggagtgtggatgtcaggtacaggccgccgtgtctgagcgagggtggactacacactagggagcctctgggccactgggtgacactctgagaagtgtcacttgaaggtggcaccagcgcacttggaaggcattgagtatctgcagtcacagggcccctcctcacgatggaatgtccatacccagcacttcccctggagttctgttgagatgctgaaatgacctcataatcattattatgatgtttctgatgatttctaaacttgagcaaacttaaagcagagaatgcagaggtcttttccagatgtttctagtctttgtcacccaccccagcgaatgtcagggcaaactcagaactgcaaggctgcccaagagtccacctgatcatctggggctgggcagtaatgcacgcagtgtagcacatggtacacttgttttcacccaacaatgactgt

SEQ ID NO: 402941 - DNA, 247 bp, Homo sapiens
aagaccagtcctaataccgtttatgtagttttatgtaagagaagaggtaactggaaaatggcttctcagaacaatgaataaatattttggttctggttaattaaaactgccatagtttctttaattagaaaattatgctgttttcgagccaggtgtgaatgaaccccacagtaaagccagctttaagtgactcgatgtgaccttatcctttacagttagaaaacgtttccatttaagactttttttc

SEQ ID NO: 402942 - DNA, 508 bp, Homo sapiens
gaccagtgtgaaggcaaagatccacatctgccattccctccccaggctctagaaattgcatcaggtacaaacttagcaggttgatcactatcctagctcccatctcttcctggctgcctttgttaacaaaagtgagactgattttctttgtaagtatcaatgctttttgaatcatcttataaacaaagcatattttaagtttattacttcttccttctaacaggcaagaatttaatattcttccaaggctggtaagaactgtgcttaagacattccaccgaagtctcagagtctcatctaacattttttattcctttttaatcaatagagatggggcctcactatgttgcccaggcagatctcaaactcctggccccaagcgatcctaccacctcagcctcacaaagtgcagtgattataggcataagccactgtgcccagccccaacaaattatttattcaaagccacctcactaaaattccacttaaacacacaggttaattcact

SEQ ID NO: 402943 - DNA, 376 bp, Homo sapiens
cgcacagaggtgaatgatttcccaggcgaggctggctttttctcctggtgtctctgtacccttagcacccgccactccccagcctgcccagggggcctggaggactgcctctcacatgtgcacgcacaggacagcctgtcctgtgcggtggcggtcacagcattttctctacctttcttgaaagtgaggcctgcagagactgaaggcgcttggagggaaggttgtcacactcacggtggggagtgacagcttctgggcagaacaggagtcatgcacgtgcagaagcgctggtctgggggcagttttcaggcagctgccaaccaagcctgatgcctgtgggatgggggactgttgttgcatcctcgtggaaagtcag

SEQ ID NO: 402944 - DNA, 436 bp, Homo sapiens
ttttggtagcgacagggtctcaccctgtcggcgcagggtggtctcgaactccaagcctcaagtgagcctcctgcctcagcctctcagtgttgtattataggtgcatggcctcaagtattatttaagaaataattattaagaaatacattatgcggctgggtgcagtggttcatgctgtaatcccagcactttgggaggccaaggcgggtggatcacttgaggtcaggagtttcgagaccagcctggaaaacatagggaaaccccatctcttataaaaaatagaaaaattagctggacatggtggcgcatgcctacagtcccagctattgggaggctgaggcaggagaattgcttgaacctgggagctagaggttgcagtgagctaagatcacaccactgcactccagcctaggcaacagagtgagactccatctca

SEQ ID NO: 402945 - DNA, 608 bp, Homo sapiens
tatttttatttccctagtaatttgccctggcagactcgggggtcaaggacctggtgttgcaaaattccagtagttaccatgtccagaagatatactgtaaattgtgcttccagaagttgggtcatacaatggtacaaatggaaactttgatttattattttgttgcttcttgttaactaattttagaagactgagagtgggggtgtccatgctttagatccttcaaagaagggattaatgaaaatttgttgttgctttttggtaaaaactactcattgagctaacagctaaaaaactgaatttcaatattaccataaatttgaagacaaaatgtttccttgtggaggaggagtttgggcaaagtataaataagtaattaaaattgtgctcaactaaagagtttattgtggagggaaaagtgatctcgtgttcataagtggaaattaaatgtttttatagagtggtgcagttattgcgacagtgcaaattatattaatagctaatagagaattcaaataaaatgtttctaaattataaaggcctaccccttttaattgagttttgtgtgattgtcacatgaatgaaataaaatctaagtgtttctcatt

SEQ ID NO: 402946 - DNA, 367 bp, Homo sapiens
ggttcgaccttgtttatttcccatcactcatagataactctactgcctgataatcagtgccttgaaaaccattgcttcagcccgggcgtggtggctcatacctgtaatcacagcactttgggaggccaaggagggcagatcacaaggtcaggagtttgagaccagcctggccaacatagtgaaaccccttctatactaaaaatacaaaaattagccaggcatgctggtacacgcctgtaatcccagctacttgggagactgaggcaggagaatcgctggaacccgggagacggaggttgcagtgagccaagattgtgccattgcactccagcctagaagacaagagtgagactttgcctcaaaaaaa

SEQ ID NO: 402947 - DNA, 588 bp, Homo sapiens
gggagtatagtcatgtgccacaatgcccagcgaattttttaatttttagtagagacaggttttgctatgttgcccaggctggtcttgaactcctgggctcaagtgatcctcttctttgacctcccagtgttggcttttaaaaagattcgtctgtaagtatttctgcttgtctttaaatgatgaagtctgttttgttttgttttgttctgtttctttttttctttttttgagatagggtcttgctgtgtcacccaggctggagtgtagagacgtgatcacaactcactgcaacctcagtctcctgggctcacacgatcctcctgcctcagcctcctgcatagctacaggcgcaagctgccacacccgactaatttttttatattttagtagagactgggtttcaccatgtcacccaggctggtcttgaactcctgagctcaggcagtctgcccgcctcggcctcccaactacttgggagactgaggcaggagaatcgctggaacccgggagacggaggttgcagtgagccaagattgtgccattgcactccagcctagaagacaagagtgagactttgcctcaaaaaaa

SEQ ID NO: 402948 - DNA, 476 bp, Homo sapiens
cgccgccgccctcccccctcctctctctcggccgctcgtgcgctcactctccccgttgactgctcgtgactggttccgtgcgctgctctcttctcttgcattgccttcttcgttctctctctccttgttgtttcttttcttttctctttctgctcttttttttgtttttttttgttctttttttttttttttttttttttttttttttttgcagggttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402949 - DNA, 6310 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagggggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcgttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagttaataatgtatatcagtttttctgtctcactgtgtaacaagtcactcagttttattttaactttagacggtcttgtatcagtggtggtctcttgaattttgtaagttcatctgaggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaaca

SEQ ID NO: 402950 - DNA, 5661 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagggggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcgttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtagatacccaatagtgggattgctggatcaaatggagttctacttttagttctgtaaggactgtatttctaagagaaagcaactgagcaatagcattaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402951 - DNA, 5397 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagggggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcgttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttaatcttatattaaggatttgtggaaggaatagtttacggagcagtgcatgtgcgagtattgtcttgtactgaacagtggattttttgattgcaggttggggttggagtccttttggtaagaattttctccccgaaaggggaggttcgggtggagataaaaaagggcctggt

SEQ ID NO: 402952 - DNA, 1622 bp, Homo sapiens
taataatatatgttgactcacattaataacatcaccattttatcaattacataataaaacaaattgtcaacgtatccaaatattaagttacacagctcaaaaggcatataaaatattagatgtctgctcaattcattagcagaaacccatttcttttttgcaagagaggttgggaaggaaaaaaaaaatcacactttcaaacaaaaataagttggtaaacacacttctgataagtatgggaaaaaaattacaagaggtgtttccctttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402953 - DNA, 896 bp, Homo sapiens
ctggccccccttgcagatctatgcaggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402954 - DNA, 662 bp, Homo sapiens
gctcggtaccgactttcagtagtagggagaaaagatttttcaggtgtagctaccacaatcaaaggtatatagctacatacgcatgtatatattacagcttatctgtaagaagaaaatgcattttaaacacaactcttctcagtagcattttatgacctttggatatgtttgtaatcatttcgaatcaaaatattgatttaattttgacctctggtttaagatactgctttaactactgttgacaaccaagtagagtgacttaagctgaacagtaactaactggaaaattagataagcacctggcatctaatggcaggcaggcactcaagaaatgaattaactacataatggaaaagtatggtttaatgtgtccaaatgaaagctagtagatgtaaacatggaaaaattgtgtttacaattttataatctcagttgataagactataagaaagctgattatttaaatcactatatacaatacacccttaatttgttcattccagaaacatactgagatgtcagctacttaaaaatggtcacaaaaagctactgtttatatttttcctcctgctattctctcccaaattaattattaataagtgttgttcatttactgcactgctgagaactaattaaaattatatattccagattgtaaaaca

SEQ ID NO: 402955 - DNA, 5615 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagggggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcgcctccagacaccattccagatcaactggtgccctctacgcccccgaagtgtatggggcctcaggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402956 - DNA, 4781 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcagatgataaacatgactgggatcagcgtgccaatgcactgaagaaaattcgatcactgcttgttgctggagctgcacagtatgattgcttttttcaacatttacgattgttggatggagcacttaaactttcagctaaggatcttagatcccaggtggttagagaagcttgtattactgtagcccacctttcaacagttttgggaaacaagtttgatcatggcgctgaagccattgtacctacactttttaatctcgtccccaatagtgcaaaagtcatggcaacttctggatgtgcagcaatcagatttatcattcggcatactcatgtacccagacttatacctttaataacaagcaattgcacatcaaaatcagttcccgtgaggagacgttcatttgaatttttagatttattgttgcaagagtggcagactcattcattggaaagacatgcagccgtcttggttgaaactattaaaaagggaattcatgatgctgacgctgaggccagagtggaggcaagaaagacatacatgggtcttagaaaccactttcctggtgaagctgaaacattatataattcccttgagccatcttatcagaagagtcttcaaacttacttaaagagttctggcagtgtagcatctcttccacaatcagacaggtcctcatccagctcacaggaaagtctcaatcgccctttttcttccaaatggtctacagcaaatccatcaactgtggctggaagagtatcagcaggcagcagcaaagccagttcccttccaggaagcctgcagcgttcacgaagtgacattgatgtgaatgctgctgcaggtgccaaggcacatcatgctgctggacagtctgtgcgaagggggcgcttaggtgcaggtgccctgaatgcaggttcctatgcgtcactagaggatacttctgacaagctggatggaacagcatctgaagatggccgggtgagagcaaaactttcagcaccacttgctggcatgggaaatgccaaggcagattctagaggaagaagtcgaacaaaaatggtgtctcaatcacagcctggtagccggtctgggtctccaggaagagttctgaccacaacagccctgtccactgtgagctctggtgttcaaagagtcctggtcaattcagcctcagcacaaaaaagaagcaagataccacggagccagggctgtagcagagaggctagtccatctaggctttcagtggcccgaagcagtcgtattcctcgaccaagtgtgagtcaaggatgcagccgggaagctagtcgggagagcagcagagacacaagtcctgttcgctcttttcagcccctcggtccaggttatgggatcagccaatcaagtcgactgtcgtcttctgttagtgccatgcgagtcctgaacacaggttctgatgtggaggaggcggtggcagatgccttgaaaaaaccagctcgaagaagatatgaatcatatggaatgcattcagatgatgacgccaacagcgatgcatctagtgcttgttcagaacgctcctatagttctcgaaatggtagtattcctacatatatgaggcagacggaagatgtggcagaagtcctcaatagatgtgctagttccaattggtcagaaaggaaagaaggcctcctaggtctgcagaacttattaaaaaatcagagaacactaagtcgagttgaactgaaaagattatgtgaaattttcacaagaatgtttgctgaccctcatggcaagagagtattcagcatgtttttggagactctagtggatttcatacaagtccacaaagatgatcttcaagattggttgtttgtactgctgacacaactactaaaaaaaatgggtgctgatttgcttggatctgttcaggcaaaagttcagaaagcccttgatgttacaagagagtcttttccaaatgatcttcagttcaatattctaatgagatttacagttgatcagacccagacaccaagcttaaaggtgaaggttgctatccttaaatacatagaaactctggccaaacagatggatccaggagattttataaattccagtgaaactcgcctagcagtgtctcgggtcatcacttggacaacagaacccaaaagttctgatgttcggaaggcagcacagtcagtgctgatttcattatttgaactcaataccccagagtttacaatgttattaggagctttaccaaaaacttttcaggatggtgctaccaagcttcttcataatcaccttcgaaacactggcaatggaacccagagttccatggggagtcctttgacaagaccaacaccacgatcaccagctaactggtccagtcctcttacttctcctaccaatacatcacagaatactttatctccaagtgcatttgattatgacacagaaaatatgaactctgaagatatttatagctctcttagaggtgtcactgaagcaatccagaatttcagcttccgtagccaagaagatatgaatgagccattgaaaagggattctaaaaaagatgatggcgattcaatgtgtggtggtcctgggatgtctgacccaagagcaggaggtgatgctactgactcaagtcaaacagctcttgataataaagcttcattgctccattcaatgcctactcactcctctccacgctctcgagactataatccatataactattcagatagcatcagtcccttcaacaagtctgccctcaaggaagccatgtttgatgatgatgctgaccagtttcctgacgatctttccctagatcattctgacctagttgcagagttgttgaaggagctgtctaaccataatgagcgtgtagaagaaagaaaaattgccctctatgaacttatgaaactgacacaggaagaatcttttagtgtttgggatgaacacttcaaaacaatattgcttttattgcttgaaacgcttggagataaagagcctacaatcagggctttggcattaaaggttttaagagaaatcctaaggcatcaaccagcaagatttaaaaactatgcagaattgactgtcatgaaaacattggaagcacataaagatcctcataaggaggtggtgagatctgctgaggaagcggcatcagtgttggccacttcaattagtccagagcagtgcatcaaagtgctttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggac

SEQ ID NO: 402957 - DNA, 2361 bp, Homo sapiens
gcaggccgagcccagtggcgcaggcactgagctgtacttatttgctgtgctatttgacctcttggtttcagagagctccctggaccatctaatggctatgggagatgataaaagcttcgatgatgaagaatcagtggatggaaataggccatcatcagctgcatcagccttcaaggttcctgcacctaaaacatccggaaatcctgccaacagtgcaaggaagcctggttcagcaggtggccctaaggttggaggtgcttctaaggaaggaggtgctggagcagttgatgaagatgattttataaaagcttttacagatgtcccttctattcagatttattctagtcgagaactcgaagaaacattaaataaaatcagggaaattttgtcctatcattcaaactgcagactacccaattaatctggctgcaatcaaaatgcaaacaaaagtgatagagagagtgtccaaggaaaccctaaacctgcttttgccagagattatgccaggtctaatacagggttatgataattcagagagcagtgttcggaaagcttgtgtcttctgcctggtggctgttcatgcggtaattggtgatgaactaaaaccacatctcagtcaacttactggcagtaaaatgaagctactgaatctttacatcaaacgtgcacaaacaggttctggaggagctgatcccactactgatgtttctggacaaagttagtgaagctcatcacagcgaaccaggtctctcaaaagaaaggacagatagaccaccctcatcaatgaaaggaagttctcaaacacatcctttggaacttactattgtttcccagttttagttttttgtttcgtttcgttttgtattttctgtaacagaggactatcctcagtctgcatgtaacttttatgatagttattccaaattcaagaagaagcagtattaacatcaattgatcgacacaaagtaatttttaatttaattcatcatttcacatgtttgtactttgtcttcccattaacctttgccagtgttatgattgtataaatttttttaaatgctggttaaacaggaatgcttaaagctttaaaagtttaacagtctaaaacatttttgcttttattcaactgcagaataatatttttattgctactttgagttttgtttcgtatcatgtcctatgctagaaatatttaaatgatgtgaaacaaagcaggactaatttgaactacagctggactccgtttgtgtgatggtgatacatgtcattagttgcaacttctttggggtgatctatagtttgaaaactaaaacctcaaagacagatgttacagaatcagccagttctgtaaaactgatattgtctattggttattgatcttgccatctttatttaaaaccatgtcccttctatgatcccttaagaaagctgcaccaaatcatctgcctgttttttcttgatacttactgaaatagaaggttttattgcagggtttattttggtttgtttatatctttgttgtgaatgatgcttttttgtatttattaatatcaaattcacttatgaataaacttgataatggaaacggacaaaaaaaatcaagtgcgtgtgtgtccttgaccgtcttctgtttctcacgtaataaacaaattatcgagacatgggagtgaccagcaccttttctttaaatggtggaacctggtttccttttaccatgaaattgtcttacttgaaaatattgatcctgatgagagagaagatggtgccaaggctgtctttgtataatgggctcaaattctctacctcttcagggctaatacttttaactgagctgctgcctatagtgtcttttggaaaactacttaaagggtgattttctgttactttttagcaaatttttttaatcacctcttgctacacccattcttttcatgtgcagccgactcaaaaattaccagttttggtgaaaggctaaattagataatttggaaccaggatactaatgatttctcatctttacttttttttaatcctaatataaagtgaatttgattgaaaaggcaaatagctattagggaagcagtttgccattgttgcagagttatctgtactttgtttaactgaaaaaaatgtagaaatatatgtaaagaatttaagacaagagtactgaatggatgatttgtcataggctttcccctttctttctgttctagcagcaggaaaagtttctctatatcctctccctctacctgtaacaattttgttttctactgttaattacattgtgtatttatagttctatgcttactgttgtgcatatactggcaataaaactgtacataacattacttgaaaaagtta

SEQ ID NO: 402958 - DNA, 527 bp, Homo sapiens
ccaccaccactccattccccagctgcccaccccaattccctaacagataattctccctaatgtttattgcctttctgcttatttattagccaggctatgtcaaaatgtatgctaaatcaatgttgtagcacagctcagctgtgaggattgatttcttttatttaaggtgaaacaagtttagtttggagcccagagcaaaattctaacgtgctgaaaacatgctgcctggcaagattcctgggaaggattcctaagaatcctcccaaaagctggagcccctctgggaaagcagccttcaaggcacatggttcccaaggtaccaccagcaaatccaaggaggacaagagagagggaaggttcagggctgagtccctcccatgtgcccagtaagagcaaaacagaaaccaccacctcagcaatgttggggagggtatgtgtgtcctccctcccactccctagctcagattactaaatacagaaactgaggcacagaagtgttgagaaactcacccaagccacatagctaa

SEQ ID NO: 402959 - DNA, 444 bp, Homo sapiens
cactttgttagcctcaccgctataattagtttcaatctcctagattgcatagcacaacttatgccagtaacaccaaaaatacacacacacacacacacacacacatgcacacacaacataaacacatgtaaatgtaactaaaacctaccagaaatcatatatcttgttcagaagtgttttaataagtcaaatgcatgaaaaatagctaattatataaaatttatctttttaaaattgcattgaaatggctgatagaagaggatacaaagggaccctccccacattgatcctccccacctcccagcctttacccagagatagttgtagaattagtcctatagggcaggaatggaaaggccaggctcatccatgtgaggagagagcaggtaagttgtgggttttttgaggggaatctactgtttcatttaaaaaatgtcaacataa

SEQ ID NO: 402960 - DNA, 282 bp, Homo sapiens
tgagttccaactggtcaaatcaggaacaatttgagcaccaaaataaataagtgtccaaggctgaatgtgaaagcacctttgtcacatatggaccagttcccctccacaaaggaagttttgttctgcagctccgttcagcaacccatcaagtgcttggttctctaccttttgacaacagaggatattgttatgattttgagtttttgcctattagtgaagaatgatacctctgtgtaattttaatttccatttatcatactataaaataatttgaacattttt

SEQ ID NO: 402961 - DNA, 817 bp, Homo sapiens
cctgggcaacaaaagtccgtctcaaaaaaaaaaaatagtgcctattagaatcagattagaggctgtaggggctagagccaataattcaggacagtactggcaccaagctccttgttggcttgaagacatcaacacagtccttgatcccaagagagctatggaggctgcaacagcagcaggacaaggctgccttccctgaggtttggttaaaaacacatcgctcaagtgtgtcctcaagagccagttatggccctgtgttaataggcctcactgggaatactatgtggcagtggatgcagcgagagctaccttttcagtataaggtattttcagcatacctgagggacttccagagagtccttggcaggggctcagcgattgacagttcacgctaagatactggttgacagtctccccttatccctagctgaaaaagaggagccccttagggcctcccagagacagacaagctgagcccaactcagcacagtatgaagtagccaatcagctgcttgcccaaggaaactgtttttaccagttttagcgaaatagcactggacagttgccaatcactaacactgtgtgtgattgcacccaagtatttccctccatcagtgaggcagtacagtggggcctctgtatgtgtttgactaaattgcatttctgttttgctggagaaaagaccaaactgaaagaggcaggcttctctttgtgctcctgatacgacgttgccacagttaatccgttctgatctctgctttgattaacagaattagagaaataaactgtccaggatgatctgtatacgtcaggaaaa

SEQ ID NO: 402962 - DNA, 258 bp, Homo sapiens
caagccgcccaacaagtcaaggagccaagaaaactgcccaggaagtagtgccaggatgaacatctccagggtccataggaggcatccagaaataccacctacccaaactgagacaaaaacttcattttcatcatcatcgtcatcatcaaaatcatggatcattaccaccaccacatcacttacaagcgggttgtaagaaagtcatactctttcttatttgcccacgtttcttgaaattattactttattaaactacat

SEQ ID NO: 402963 - DNA, 583 bp, Homo sapiens
ctgcactattttggggaccttatggagtgccagtggtgttcccgagggagtaccgtgggcagctcctggctggattgattcccacctctgttgcaggacagtgcccggcccataccaagttcatcctgtgtgttgagtgcagtggcgtgatcgaccgagtgagtgaggaactcaggcctagggatttgctggctcccatttgggctctgccatttctggttgctatgagcctcccatcactgtgcttgactttcatctcccaagtcacccagcaatacctgtggcatctgtccaaatactggtggtggtctcaccgaacccacaccaggtcatacctctgaaatctttgcctaacatccatctcccaacctccattggctcctcagcacctgtgtgtataaatccaggtggttggcacctgttcctggcatctctgcaggatccaggccctgccttcctctccagtcttatttcttgcaggcaccaccccccgctgcatctccaccctctggatgggtgcaccatactaagctcttgcagtgacgggcagatgttttattgttttacactctgtgcttctgtt

SEQ ID NO: 402964 - DNA, 702 bp, Homo sapiens
tctttatgcttttttattcctgtggaatttatgtgttgatgaatgtgtgtacttatgtaaaatgagggaaaagtgaagaaattggggtgaatggctaaataggggtcataaaaatgagcacaaattctgttgaagatggctcttgaagtgcagctccgaggcatcctgtctgccccacacacatgacagccaccgatttcaagggctgatcatcggaaggctctctggaggagtctgaagcagtgcgattgggatcagctctgtcactctactgatcccagggtacatttctgagattctaaagctgtttctcaatgtaggtccataggacatctgtatcttgaatcacatttttcagcctatgaatctgcaattttccattgctatccaagtgactttacattaaggttggagacgattgtctatctcatttgagcctttcatgcattttgaattgcaccgactgggatcctgtgaaggccatgaccacactctgtactcactgctttataaaagtcatctcagtgactggtttctgtatctttttcttttaccctctccatcttgtgcagagtcatgaagggcctggggcccagagatgctgaaagctggcccgaggtccacaaccagcaagcggaggagataataacattgggacttttggcttctgagaatgcgttcctctgccttacagaaaggaaa

SEQ ID NO: 402965 - DNA, 500 bp, Homo sapiens
caggcatggtggctcttgcctgtaatcccagcactttgggaagccaaggtgggtggatccctgaggtcaggagtttgagacctgcctggccaacatggtgaaaccccgtctctactaaaaaaaaaatacaaaaaattagccaggcatgggggcgggtgcctgtaatcccagccgcttgggaggctgaggcaggagaatcgcttgaacctgggaggtggaggttgcagtgagtcaagatcccgccattgcactccagcctgggcaacaagagtgaaacgccatctcaaaataaataaataaattttctccatagttcctatttagtgtcattttctttttgaaataacaaatctagtcctgcacccagatttagtatcattttagagtttataaaattgatttgctttatgattccaattttgaaatatcaagtttaaagctttaaaattatattttttcttttgggccacattacatggctcttgcctgtaatcccagca

SEQ ID NO: 402966 - DNA, 478 bp, Homo sapiens
tttttagtttgtcattgtattgtttatttgtaaaaggtctttttatattctagatatgagtcttttgtcagataaactattgagaaactttttctcccaaactagcctgttttctcattttcataatggtatcttttggtgagcagagatttttaattttgctaaagtctaatttatcaattttaaagtttatggtcaatgatttttttgtttcttgtctaagaaatctttgctttcttcaaacttacagtctcttatgtttcttttagaagctttataattctggattttatgtattggtctatgatccagacataagtactctatgtatggactgagatacaagttagagttcatttttcccccatatgtttacccagtaattccagattcatccagttgtcccagcaccaacttttaaaaaatttcaatagtttttgaggtacagatggtttttggttacagggatgagctcttt

SEQ ID NO: 402967 - DNA, 384 bp, Homo sapiens
atattacttaagtcgatgcagtctgacaagacctagcttgacacaattataaagcctgcgttgctcaatcagccagatccaaacaactctctattctttcttcaaatgtgtgtggcttgctggatgcaagatcagaatgcagacaacaacctagcttctatgcacccgctggctcacagggaactctgaaataagctggcatctgaaacacaccctacaggaacaggatagggcttgaggctaaaaccccagtttgcagtggcagaagaaaacaagaagaaaggaaaaaagggctgtcaacaaatgcaggcagaatgagcaaaggacacacttatgtataaattctgccgaatggttcaaaacaactcagtaaccaggtagcat

SEQ ID NO: 402968 - DNA, 722 bp, Homo sapiens
tatgcatgcacactcacacatgcatacacacatatgcacacacatgcatgcaaactcacatgcatgtccacacatacagacacatgtgtgcacacatgcacactcactcacacacacgctagtccaagtcctcctggggccagtcccagcacagtctgaatgcagtgaaaaccttcacagagaaggtggctggccccagccacagtcgtgctgggacacagagacgcgcagggcatgacctcaccctccaaaggctcactgtcccatcaggagtcacatcacagatcaagctgaacctgtcttccctccagagccccacactccagtctgcaggcccctgggtgggccttgcactctcgctcaggcctttgcacctgctgtgccctttttaagaaatgcccttccccgctgctggctccctcttagctcttgtgggctcgtcaacacctcctgttgtgcccctcggttgggctccctcagcccctccttccctcctcctccaggatgtggaggtgtcagagcccccatgcactggctcctggagaacagggctgattgctttcatctgtgtgtgcccgggcctgctacacataacaaggcctggaaaggcctccgaagagaggggccgttgatgcaagtttggaagaatcatgagccatgaagaaggtgaatggtgagggatggggcagtccagacagaggggacagctcaggcaaaggcac

SEQ ID NO: 402969 - DNA, 272 bp, Homo sapiens
aggatttgctttatatgctgctttggggctcctcatcgcccatgctgtaaaagctattttctacctgtcaatgcctgattgcttttctgctgtgccagcaacaaagtgtttgttttgaggaattattatgtgcagacacagccccaacaagcccctcacccacccaacctcatttctgcaagatcattgctgaaacacagacctatttatgtcttaggcgcccagtactgggcttgacttgtacgttcttaataaatacttaatgatggact

SEQ ID NO: 402970 - DNA, 1206 bp, Homo sapiens
agagcaaaatgtagcaaattagcttatcacattctcacatgagtctatttgtggcttctttggactggcctcaacctgctattctagagatacttagctaattccagatcttaagtctctggtcttaaggttcttgggaaatgtatataaattccatctcttcacctctttaaagtggtaatgtatccactgcactaggtgtgtggtttgccagactaggacaaatccctgaggaccctggagctaccatcttgggagcaagttaggaccatcttatggtttttgtgggaatttgcaggctgtagatgtagggatttcgaacccaaggttatgagggtaggtgaagtatggaaactctagaatcaggttgaaaagatttgtattttgcaggggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcagtgagatggggctgggcagaggagctgggggtgggggaagatgggcagccgagaaaagaagtgagaccaaggcagaaaatgtgtccagaagacagccacagcctcatttagcccattctggactggggaccaccatagagaaattcaaactcctaaaactaatggataacttgcaggagattggggtgggagagggtacaaagtcaccaccgaggcttagcatctattttatactctttactcaagaaggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctattgaccagaaatccatagtgttgagaatgctgatttgctcatgttttcaataataataaaataaaatacattcacacagacatacatttttgagagtattaatagtacctataaaatctggaacacagtgcctgcaataatgaacatgtaaaagcctgtagctgttattgctattataaaagatatatgaacagtcatttaaaa

SEQ ID NO: 402971 - DNA, 563 bp, Homo sapiens
gggttgcgctctgaatcactcaggtcgccaggccgagtctctgtccgcacggagactcaaagtgaaaagcttcggtggatctcagccttggccatgccaagagaggagttggaccttctggagtgttacaggatatgggggacaatataacatccatcacagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctgggcggtcgtcgacatcgcctacgcctgcaacacggtgccccggatgctggtgaacctcctgcatccagccaagcccatctcctttgcgggccgatgatgcagacctttctgttttccacttttgctgtcacagaatgtctcctcctggtggtgatgtcctatgatctgtacgtgggccatctgccaccccctccgatatttgggccatcatgacctggagagtctgcatcaccc

SEQ ID NO: 402972 - DNA, 2348 bp, Homo sapiens
  misc_feature (1860)..(1860): n is a, c, g, or t
  misc_feature (1894)..(1894): n is a, c, g, or t
  misc_feature (1897)..(1897): n is a, c, g, or t
cctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaactccccccaggtacagngccttcgagctacaagcccgagagaatgatgaantgncactggagaaagccgacgtggtgatggtgactcagcagagcagtgacggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggctcctttcgtgcttgtgcttggtgcggggggattcgacggactttgccctggactctggaacctttcatcatcacacgggggacctgggg

SEQ ID NO: 402973 - DNA, 2275 bp, Homo sapiens
cctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcaaagtgaaaagcttcggtggatctcagccttggccatgccaagagaggagttggaccttctggagtgttacaggatatgggggacaatataacatccatcacagagttcctcctactgggatttcccgttggcccaaggattcagatgctcctctttgggctcttctccctgttctacgtcttcaccctgctggggaacgggaccatactggggctcatctcactggactccagactgcacgcccccatgtacttcttcctctcacacctgggcggtcgtcgacatcgcctacgcctgcaacacggtgccccggatgctggtgaacctcctgcatccagccaagcccatctcctttgcgggccgatgatgcagacctttctgttttccacttttgctgtcacagaatgtctcctcctggtggtgatgtcctatgatctgtacgtgggccatctgccaccccctccgatatttgggccatcatgacctggagagtctgcatcaccc

SEQ ID NO: 402974 - DNA, 386 bp, Homo sapiens
gttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgtgagactcatcccccatttaatccccatgtaggccctgaggtgaccatgcaccagtccccagcccagagggctatcccaagagcacactttccccattccgccctctgtattggttaccccagcatcacatctgagcgccctgtacatcagctcccaccgctctttcccagcccacagatactccactgacctcccttccccgcaccttcactgcatcccccattgctcccc

SEQ ID NO: 402975 - DNA, 2425 bp, Homo sapiens
cctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcagtgagatggggctgggcagaggagctgggggtgggggaagatgggcagccgagaaaagaagtgagaccaaggcagaaaatgtgtccagaagacagccacagcctcatttagcccattctggactggggaccaccatagagaaattcaaactcctaaaactaatggataacttgcaggagattggggtgggagagggtacaaagtcaccaccgaggcttagcatctattttatactctttactcaagaaggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctattgaccagaaatccatagtgttgagaatgctgatttgctcatgttttcaataataataaaataaaatacattcacacagacatacatttttgagagtattaatagtacctataaaatctggaacacagtgcctgcaataatgaacatgtaaaagcctgtagctgttattgctattataaaagatatatgaacagtcatttaaaa

SEQ ID NO: 402976 - DNA, 1691 bp, Homo sapiens
cctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcagattcaagaggtccagccgtggagaaacatccgggaccctcagacactgttgtttttcgggagaaaaaaccaaaggaggtgatgggaggcttttcaagacgctgctccaaactcatcaactcctcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgaatagcaacagcaatttccgggaggtcttggagaagctggagagcgaccccgtctgccagcgcctttccctcaagtcctttctgattctgcccttccaacgcatcacccgcctcaaactgctgctccagaacattctgaagagaacacagcctggctcctcggaggaggcagaggccacgaaggcacaccacgccctggagcagctgatccgggactgcaataacaatgtccagagtatgcgacggacagaggagctaatctacctgagccagaagattgagtttgagtgcaaaatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagtcagtgactggagtggcaggccagggcacaagaggggaaggggatgaggaaagaggggggtctgaaagggagagagaaggg

SEQ ID NO: 402977 - DNA, 179 bp, Homo sapiens
gtgaattgctgctcctccttccaagttggaaattgaagagatgttgtgtagttgtaaatgctgaatgcagtgactgaatgttcactacatttttggtttacagcaatagtagatgtattaactatacttgcacaataatcactattttatttttgttcaagtataggccttggaacttt

SEQ ID NO: 402978 - DNA, 331 bp, Homo sapiens
tagatcatgagtgttgactccattaggacttctaatttcactaagtgatgcaatcatttttaaaatttacttttattttaccatctttattagtcttttaatccaatgctttatgcttagttcctaaattacttgcaggaaagatagatcaagattagaaacaaaaatagcaatcggaaattctgtacagaagagagaatacaataagaaaatttaccttgggaggccatggtgggtggtcacctgaggtcaggagttcaagaccagcctggccaaagtggtgaaactccgtctctactaaaaatacaaaaattagccaggtgtggtggca

SEQ ID NO: 402979 - DNA, 294 bp, Homo sapiens
aggcctgggacagtttcttcatccttatgtctcagtttactcttatcaaaatgagaatagtatatgcttctcagggtattctgagggttcgctacatgaatacacttgaagtaggtaggacactcagtgtctgggatgcaggaaaggccagacaaacattagctgttgtggctgttgttgttttatatcagttgtcaaaaagaatagctggtcaggagagggaggcagcagtgagctatgatcatgccactgcactctagcctgggtgacaaagcaagatcctttctttaaaaa

SEQ ID NO: 402980 - DNA, 532 bp, Homo sapiens
accctccccactcccccacgtatcttttagagtgatggaaaatcacctggcgccgaagaaccatcattggacaggaatatagaaggcaagctacatggcagacaggccgtgagtccttcctggtacagcaatcggccacatcgctaatcacagccgtcctttctgctgagctaggacttggcctcaacatcattctgaagccagtgctccaggaatccagtgctcatcagtcagcatcaggacccgagagcaaacctgttttccgttgctgaagaggtaggagcacaaactggcacttttataaccagagttcaagctcagcaggctggggaagggtctccctgcctggggagctgtgctgcccctgccgtttgcacacagtatcctgggagggaggtttgggcaccaagccatgacacgttagcttggcctcctggccaccccgagtgctctgtggctgaggctactgttggttgccaaaatattggcccagaggccttttggcggttagggccatagaactgcatagaac

SEQ ID NO: 402981 - DNA, 418 bp, Homo sapiens
ctcgacttgcagagtagcactttccagtgctttagtgactacttcctgtatgaaagcattcatacaggcattcaaaagtatgtctcagtgaaataatagattgctacatcactgacctttagtatcatttcaaagtttaaattccatgagtaccaagggtatgtgatgaagtaatagctctagcaaacgattttgttctccaaatgaaaaacgaatgacttctaacagagtcccattctgtgagctgaggactcctagtgggcgttgtaataataactcttctgaaaataatttttcagatgcatgtatatgctgttgtgattaacaaaatacagtttcatttaaagtattgcaaaagttacaaggacttttagttatgcattttttcaatgaaaagatttccaaaatatcactaact

SEQ ID NO: 402982 - DNA, 277 bp, Homo sapiens
taagaccttcagtgtatactaaacttgaagtggggcagcaggaattctgcctttatctctagaatatcaagtctatcctctgaaactttcacttgtagatttctcacttttgactttaaactgcctgagggcaggagcagtgtttgtgtttgctggctgcctgtcacccgttgagcacaatgctgggctcagcaggcacttaagaaatatttgcagtcaggacagtggccacacctgtaatcccagctactcaggtggccagtgcaggaggatctct

SEQ ID NO: 402983 - DNA, 643 bp, Homo sapiens
aggacgaccttgtctgagatctgttgatctgtgtaatcatgcaaagacttagggaatagtatcaagagcaagagcgagctgaggtgaaaaggtcctaaagtggaaatgagcttggtgagttcaaggaacattgctagagaaggtgggccaggaggaaatgagtgaacagagatgagcagaggacaggtaatcctgttgcaccctgagatctttggtgaggatttgaattttattctcagtggaacagaaagcccttggaaggcgctctgggctgtgtcttgaatagtggcgatggatctgcatgactgcatcacattctttcttctgcccacttccttgaacttgtggtccttggtatatacttcaaaagttgctgaccagagttagggatgaaacctgtggttatggaacacaggaatgctctgtgaacccatgacccacctttcgtgggcaacattcttgaagcagctagactagcccactgtggatgacctgtgacttgcaggatttgcagacctgtcacatcctatgacttgcagatcttatttctaaacttgcttcctgaaggatgtagtacacctgtgtctctgcctttgcgtaaatcaaacaaagctgtctcatcgtaactgagatcgttttcaat

SEQ ID NO: 402984 - DNA, 581 bp, Homo sapiens
cggccgcggcgcgaccccagccggtgccgggacagccccgcagcctgggccgccgctccccctccccggagcccggaatggatccgtcccggaaataaataaataaacccgcggctgctccgggtgtgtgctgcgcgcacctgaggccgacctgtgattcaccgcgggagggatggcagtgacaacgctccggggaagtccacagtgactcctccgccaggacgccgctggttgtataggaaaagcacgcggacgggaagccacactcaccgaaaacctcagtaaactaaatttatgagtttacatctgttccatcaatgaccacggtgcacacctgtttggcttcatggccggcaactacagatctaggtaatggtgagccccgatgtggaaagacactacctggcatttatgtggcaaatgctacaagtattgccccttcaagtacgttagaccttgaaagggcagaatgaagggggctgaatgttcttgttattcattttgaagaaaggcatggtatttaaatatctccccctatccatgaatgtttgtataaagtacataaagaaaaaatataattt

SEQ ID NO: 402985 - DNA, 541 bp, Homo sapiens
cggccgcggcgcgaccccagccggtgccgggacagccccgcagcctgggccgccgctccccctccccggagcccggaatggatccgtcccggaaataaataaataaacccgcggctgctccgggtgtgtgctgcgcgcacctgaggccgacctgtgattcaccgcgggagggatggcagtgacaacgctccggggaagtccacagtgactcctccgccaggacgccgctggttgtataggaaaagcacgcggacgggaagccacactcaccgaaaacctcagtaaactaaatttatgagtttacatctgttccatcaatgaccacggtgcacacctgtttggcttcatggccggcaactacagatctaggtatccaagatcaagagggacaattacatattataagccgcacagagaagagtaatcaaggtggacatgaacttgtgctatataagttatgggttgaagaactctgtggaaagtagagaagaaaaaatttagggaacaagcagtagttgaatacagctatgtgaaactatga

SEQ ID NO: 402986 - DNA, 529 bp, Homo sapiens
gacatgctcacatcctggaaagctgagctggaccttgtggctgggatggcctcaaagttgattatgttgtagggtttcttctgtagaagcatccgctgatcagctgcatgtgtggggtcatactgtgcccgagcccagggaataccagtggctcctgtgtgtggaagcctggcgtgggtgcagggcttcttcaccatctccctgcaaagtcagctgcatcgtgcatgtcacctggacttactaataacatcaaacatatcttccctatccagtggcttgtacacaaagttaaatctgtagaagaagcagaatgtgttttaaagaatcaactggcaccttgaaatgttaagcattgtatactgactgagctatgatggtggtagtctggtgactcccaagggggaaaagtaactttgtgtggtttttcagggaatacatattcttgaatacctgcaagaaatagcatagctgctgtggcttaaatatacatgctcctatgaggctataagccttctctagtagaaataaa

SEQ ID NO: 402987 - DNA, 395 bp, Homo sapiens
catgtctctacaaaaaatacaaaaaattagcctgttgtggtggtgtcagctacttgagaggctaaggtgagaaagttgcttgagcctgggaggtcaagactgcagccaacatattttgagcacttttagtggtagctactattttaagcacttcacaggtattacttgatttaaccttcaaggcaacttggcaaaaggtcttattatttttgcttgtttgattgttttatagatttgttcatttaacagatatttactaagtacctttaagtgctaagcactattctacacactggtttatattagggaacgaaaaaaaaaccttgttctcatggagtttagagtctagcaaggaatgataaataataaacataatagtaaattttatagtgtcg

SEQ ID NO: 402988 - DNA, 2573 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402989 - DNA, 2883 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccagaaaaaaaaaaaaaaaaaaaaaaaattttggggggcggccggcaccaggaaaaagtttttcaaaaccaccgtgtggggccgcggcccccagtaggtaatggaacattgcgcacaagctggccaaagaatccgggtcagacaagatggggtttccacaaaaaaagccgggacaccgggcgtcggaacaacctaggttccgggtcctcgtccaccggtgcaggctatccccccccggcggggagaaaacaaacaaaaagaaaacgagccacaaaacgacaaaaacacacagagacacagagcaaaggatgcaa

SEQ ID NO: 402990 - DNA, 2519 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaaaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402991 - DNA, 1808 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacag

SEQ ID NO: 402992 - DNA, 1577 bp, Homo sapiens
  misc_feature (102)..(102): n is a, c, g, or t
  misc_feature (122)..(122): n is a, c, g, or t
agcgggcgtaggagcaatccgttccggcctgtcttagcgcaggggctgcattgcacgtggtacatgtgcatggtgaccagtacgtcagagcatccactgtgnacagataggagaagaatggnagtgtgcagtacagtcacacctagactgatcaaaaggccccgaacgagctatcggtagtctgtcttcctgagaaccaggtccagtactcccaggtagtgtccgcgtcaggtctactgccatcctatctactggagacgatcggccagggaagctcgaattgatctaacatggaagcgcgaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402993 - DNA, 2519 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagactcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402994 - DNA, 788 bp, Homo sapiens
ctcagaggatcctcataggtcgaggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402995 - DNA, 1727 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccccaccagggcttcagcaggagccctggactcatcatcaataaacactgttacagca

SEQ ID NO: 402996 - DNA, 2539 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttaattgcccacaaggaggtatttcgaatgtgtga

SEQ ID NO: 402997 - DNA, 2519 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402998 - DNA, 1437 bp, Homo sapiens
agcgggctatcttggaacaggcccgaggatagatactgagaggagcgacagagagcacgtcaccgttgtgcattgctactgccggtactgtagccggcgcgtctgcacctctccggctctgatcattggtacctgccggcgcctcggatctgaccgacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 402999 - DNA, 2260 bp, Homo sapiens
ttgctcgagatccattgtgctctaaagaagacagcggcctcagcctgcgcaccccaggagcgtggatgactacggccaccccgggcgcgcacccctttcccaccaccccagcatctctgcagcccaggacacccgcctcccccacaccccgcatccggtgtgtctccgcctggcccggccggcgcggcaggcgggccaggggaccaactgcacggcctcacctgctcttctccaccatccagacgttcagctacagctggtgggggtgagggactctgctccgtggccgccagtgtgggcttcccgggctagctctgcggcgaggtgggggagccgagtacgagccggcagaggtggggccggctgagggcggaagcggcggcgacgcgattacgaaacccgtccggctcggagccgggcgcactgctcccctctggactgcggaggcactgcactgcgcgggacgtgggagggtgcctctgcagcccctcaaggccgccgcccctgcggggagaactggagaatgcggacacctagatgaggccctggcacccaagctggggcccccggaatctcacgttccctttactcgccaggcatttcggggcaaaacgaagcggagccccccaaacccccagacctaaccaagttcagagattcgcagaagcacgccccccaccccaaatttattgtgctctacccaaaatggaataggactaggtttatttacccattgtgagggtagagaggcgagtctggaggagcagggattgggagaaggggtggaaaaatactctgattcttaaaaatactttgtaacctaaagtccttaaattgtggaagaaaggaatactcctcctttccattgtagtctagagttaagatttcaaatccataaattagaggacctaaaattagagggcaattaactgctcattcattgggcccccagtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacagattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacaaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccag

SEQ ID NO: 403000 - DNA, 653 bp, Homo sapiens
taataggcaaaaatctcattatggtgagcttaatgacaaatcagtttgttttaaacacattttattaaaatacatttagtttaaaaagtaaatttccaaactaccagctgaatacaactgtccagattcttgcaaggaaaaccaaatgctagagaaggccaggcgcaatggctcactcctgtaatcctagtattttgggaggccgaggcgggtggatcagtttagctcaggagttcgagatcagcttaggcaacatggtgagaccctgtctctacagaaaatacaaaaattagccggaggggaggcatgtgcctgtagtcccagctactcgggaggctacagcaggaggatcgcatgagcctgggaggcagaggttgtagttagccaagatgacaccattgcattccagcctgggtgacaggagtgaaatcctgtctcaaaaaaaaaaaaagaaatatatatatacacatatatatatatatacacacacacacacacacacacacacacgtatatatacacactttaatatatataaatatatttatatgtatataaaacacatacatatatatatgtaaaaccttttcccaagaccttgactctctgtgtatgtgtgtgtttgtgtgtatgtgtgtgggtgggtgtgagtg

SEQ ID NO: 403001 - DNA, 1124 bp, Homo sapiens
gcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcacc

SEQ ID NO: 403002 - DNA, 1409 bp, Homo sapiens
gcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcccgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcatgatggagggagaagtggtcacaggctcgtcagtctatcatctcacagctgaagcaggatccccagggctaccgctgtggtctctcatggagggaagggtaggacttctctgccaagttagatgtcacctgatgggtttatacagggtggctgcaccttcaggtggtttccaggagtgaggccatggcaacctgagcctctggccttgctgcaaggggccgagccactgcagtcgccatggctgtggagggcagttgctctggggaggacagaagactg

SEQ ID NO: 403003 - DNA, 960 bp, Homo sapiens
ccggcccagcgggacccgggcgtgacccctctgcccatggcagcagcccctcgggttcctcccaggctcatcgtaggaatgccccccaccgcaggcagagacgttaaaaagaaacgcggttaagccagagcccgctctcggtagctgcatggccacggctgcttctccgagccggggcctcagagccatgcccgcggcagagagtagcgcccaggctgcacggcccgtcccagaaaactgctgagttagcatccagatccagccagggcagcttcctgcacgagaagcaagcgcattatctccacagagcctgtgtgcctctctcggtttggtgtggctgtgatttttgacgcgtggtttaaatgtgccttcttgttgttttccttctgcctgtggctcccacctttctgttctgtgacgggctgtccctgcttgtcctgctttaggaggtaggtacccagtggctccccgccccctcagcggctcattcctctcgctctccccacgttggtctgtgtgagctccgctgtgtggctgccattcatccgatccatctgtggacttgctggggctgcgccgtgcacggtgtggtgaatgctacacccacccccaggggcggggctgagagtggctgggacctggagcacatggggatgctgtgtgggaaccaacttgccccccaccctgtgtctctaggggtccgcagcagtagagaagcagacagccagccctgtccctgcggcgtcaccctccaccccatactaacccagcagcgcatggagagatttcgggagtgctctaaaggcctttggagcaatttagggcaattacgggcagttttagaaatgctgaggggttgttttgcctgcggggcggggatggttgccttatgcccacagtgaagcgggcgagatgcggtagctgggttcacgcaagcctttctgagagcaggcggccgct

SEQ ID NO: 403004 - DNA, 274 bp, Homo sapiens
tttaagagacaaggtctcaatatattgcctagcctggctggtcttgaactcctgggctcaagcaatccacctacctcagcctctcaaagtactgggattacagacatgagtcactgcatctggcctcttctcttttttttttgacatataatctgtatgcatagatgtcatcagcacagggcactggccatgtgtgcatctgtctgtatgtggaagtatacagctcgctggatgctgacaatctgaatacaccccaggacccagcactcagagc

SEQ ID NO: 403005 - DNA, 459 bp, Homo sapiens
aacatgagcttgaattgtgcagccttcccaatttctgagttctactcctacacatactaacctgtggtaattcctatattttacattaatcttattcctctttcatacctgccccaataagccaagataaggtatgttaattaatgcttctacacatcgtgttcttctgtcatttatttggctaataatggacataattaaaatcattcattgcaataaccttcttagaaaagaatgctgaacagtaaaggttaaaagcaatttgtattattcttttatattctatagttaacatttttacacctgaactttgttcaaataattattttgtttaaaaaaggttacttaatgtgctttcaagtagagttaattgtgatttgaatatatttctacctttatgcaaagtaccttagcagagaatttttgaattttataactgaagtattgaaacatcgaaag

SEQ ID NO: 403006 - DNA, 428 bp, Homo sapiens
gttccttgtaggaatggaccatgtttgtgcacctcttctccctctcttcccttacaccagtggttctcttaggcgtggtccctgcccagcagtatcagcgtcccctcagaacttgtggcaatgaagattctgggcccctgcacttgaacactgcatcaggaactgtgagagcaggctcagcaatctgtggtgtaactagcatgccaggtaattctgatgggctagtttgagaaccactgccttataggatctagtattggtttacctcacagcgaacgaaaactcagctcactgactatttaatttgtagactatactaatcactgctgatttgtttctatctcatcacagctcccatttactgaatagctacactgggctaggcactgaactaggtgctgtcacatgcattgtcccttatgatctca

SEQ ID NO: 403007 - DNA, 399 bp, Homo sapiens
tcataaagctattcccaagtaccattaactcactcttagtaacagttcttcttctagatcagcactgtccaagagaaacagaacgtgacacacatatataatttgaaatttcctaggctaggcacagtggctcatgcctgtaatttcagcactttggcaggccaaggcgggaagatcacttgagcccaaggagtttgagaccatcctgggcaacacagtgagacctcatctcttaaaaaaaatacaaataaattagctggtgtcacatgcctgtggtcccagctactcaggaggtggaaggtgggaggaccaccggagcccaggaggttgaggctgcagtaagcctgtgatctccaccactacactccagcctgggtgacagagcaagaccctgtctca

SEQ ID NO: 403008 - DNA, 800 bp, Homo sapiens
aaaaaaagtcatgctttggccagatctcagggaccccttggctggggctccatgcttagggatgggcaggctggaccctaggaagtgtccttgggttaaattctgggcgttagtaagttatatcccaggtgtatactcaggttagacacttggggtgtctagcgtagacccaggcaataaacaggctagagcctgggaaggaagtgggggccccgggtccatccctagcttagattcccagcatcaccccccgcccggccattcaaccactgcagccactggttacagggggaacgcaatgaattttgggggtgcgaggcctgtgtcatgattctgggcatggggctgtggatagacccaccacgtgatgagaaggctggccggatctgtcagcagaggcacggtgctgaccccgcccggtgccccagagccgtgcccagtgcccaaaggggtgctgtgcaccatcccggctactggaacccactgccaaggattttcttttccccatccaccactgctgagaaccaatcggccaggcccagccctgtccggtgcctgcactctgggacctctgctctgacttcatgcaaacctaacctaaccttcactggctccaaaatctccatttctggatcccagtggtctgaccccacctctcctcctagccaaggtcaggcaactgaggaatggagctatttggttttcctgcactttcccgcaaaggggaaaatggtacttcctgcaaagctctctttgcagcctgggggagcatcaataaaggtttgagaaatggatccagg

SEQ ID NO: 403009 - DNA, 1627 bp, Homo sapiens
agctgtgtgaccataggcaagttacttaacctctctgaaactcagtttcctgagaggaacccaggcctctagggctcagtcctgggggacccagcatgccgtccttgttctgccagggcactggggacgctgggtgcactggagcccgagacccctcttcctggccatggctgtcctggtcgccagtactgtgggctgtgattctgagtatcctattgtccaagggtgagtgaccctcaatggggaggggttgcgtctggcccccctggggacacaaaacccccactgcatggcgcaccaactgcgccctggcgtcttgctcgcgtctgagcgtgagcagagtgtgtgtacatctttgggccgtttgcagtcacgcgtgtgcacatggcgtgcacgtatgtgtgcgagtccccgcgcgtttgtctcccatcggcgtgtgtgcacatcgtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgaggctggccacggggtgtggaagggagtcccctgagtcctcccaagtgacccggcgggcatgcgttttgggatgggggtcgttccagcctcgaagcagacggcggcgctgggtgccctggaggaggaggctcggggacgcaggcgctgctgcagaccacgagcgcggagcttggggaggcgcaggcgaagctgatggagcaggagagagccctgcgggaactgctgacccatggcttggctgaagccggcagggaccgcgaggacgtcagcaccgagctgtaccgggcgctggaggccgtgaggctgcagaacagtgagggttcctgtgagccgtgccctacgtcgtggctgcccttcgggggctcctgctactatttctctgtgccgaagaccacgtgggcagaggcgcagggccactgcgccgatgccagcgcacatctggcgatgtagggggcctgggggagcaggacttcctgagtcgtgacactagtgcccgtgaatactggatcggccgcagggccgtgcaacacctgcgcaaggttcagggctactcgtgggtggacggagtcccactcagcttcaggtaggggaagggctcctggtgaaacctgggggccacaggttagactctagaggacatgttttgaggccgaggtgggcggatcacctgaggtcaggagttcaagaccagcatgggaaacgtggcgaaaccccgtctctactaaaaatacaaaaaattagccgggcgtggtggcacacgcctgtaatcccagctaaccctggatgctgaggcacgagaatcacttgaacccaggaggcggaggttgcagtgagccgagattgcgccactgcactccagcctgggagacagagttagactccgtctcaaaaaaaaaaaa

SEQ ID NO: 403010 - DNA, 307 bp, Homo sapiens
tagtcttcccaacaatcctgcaagatatagaaccttgacatgtttctcaggctggtctgaaactcctggggctcaagcgatccacctgcctccacctctcaaagtgctgagattacagggcctatggttcatcctgcaatatcagagaatacacaactgttggaagctcatttgtgcagaagcactagttagaccaagtcccaggatggtggggacttgaactgcctcatgcacattgtacccaagagcctggcccatgaaggtgaatcagtggatacttgaataaaaagaagaatatgcgctgaag

SEQ ID NO: 403011 - DNA, 285 bp, Homo sapiens
agataagagcctggacgaagccattgggaatgcaggtggtgattgaaattattccagaggtgaaatccctgtgacttggtgattgactgggtgcagggcctatggttcatcctgcaatatcagagaatacacaactgttggaagctcatttgtgcagaagcactagttagaccaagtcccaggatggtggggacttgaactgcctcatgcacattgtacccaagagcctggcccatgaaggtgaatcagtggatacttgaataaaaagaagaatatgcgctgaag

SEQ ID NO: 403012 - DNA, 487 bp, Homo sapiens
gccctggccctggaatcagccattttcaagagcccttgtttcttttagtgtgaaatgatatttcaagactacaatctgggcactatggatgctcctgggttgatcattgttttgagaataattcagtggatagaactaggaaatagatttaaaggaaaaatacctcatatgtctcatttgctttatcccacattacactcacaacagcctcaaaataacaatattaatactagtgatcaatacgattactgaaaacagttgaaattatttttcttatgctcttctcattctcccccacattttttaaaagattgcactgtgtttttattgttagagcatcatatagtagccattaaatactaaagcctcccttttaaatccacatttaatttttaaaacaattttattaaggtataatttacatataaaaattactcattttaagtgcatttcttttgtgaaatgtctattgaagtattttgctgat

SEQ ID NO: 403013 - DNA, 455 bp, Homo sapiens
tgaaaaagggctacagaattttgcctgtaaagttatgctaatctctgtacagaaatgtctgacaattcagaagctgaaactcagcaaaatctctactttaagtgtcagataaagcctaacgtcaaaagaaagggcaagagtctcaggaaagagtatgctgacttccagggccagttcttcagaatctgctttttctcctgaaatcaggccatgcgaaaagaagatgttgcctcctggcacagatcattcatcctgcctggtcctcagtcaagtctccagcagcttgggatgtctgaagaatgaaaagcctaagagacaaggcccggggatgcccaacatacattctataagtggggaaagtggataaaatgttttctgtgtggaaaggacaaataacagttaatttctactggaaaagtaaacaaaaaccgtaattaaaattgctcaaaagtaaa

SEQ ID NO: 403014 - DNA, 335 bp, Homo sapiens
cctacttttgaggttttgagactcggactggtttccctgctcctcggcttgcagatggcctattgtggaacttcaacttgtgattgtgccatgcgaaaagaagatgttgcctcctggcacagatcattcatcctgcctggtcctcagtcaagtctccagcagcttgggatgtctgaagaatgaaaagcctaagagacaaggcccggggatgcccaacatacattctataagtggggaaagtggataaaatgttttctgtgtggaaaggacaaataacagttaatttctactggaaaagtaaacaaaaaccgtaattaaaattgctcaaaagtaaa

SEQ ID NO: 403015 - DNA, 632 bp, Homo sapiens
aaaacagtaagtttctgagcacaaagaattctggagttaactgcggtcatctgccaggcagatccttcaatcctggcaacagtcacatacgcttggtgaaaccagtgtaatttcttgctaccattatttcacaggcaagaaaagagacttacagagaagttcaattaattcctattattctgaccattgtgctaggcctttgaggagttacaagagcattattagacatgatcccttccctcgaagagtttgtaatctagtagggattttaaaaatattctgatagtggtaacacatgacaagaaagctcacagcactgagtagcatgtagttgctaaataagtggcattggccgggcacggtggctgatacctgtaatcccagcactttgggaggccaaggcaggtggatcgcctgaggtcaggagtttgagaccagcctggccaacatggtgaaaccccgtctctactaaaaaatacaaaaattagctgggcatggtagcatgtgcctgtagtcccaggactcaggaggctgaggcgggagaatcgcttgaacaggggaggcagaggttgcagtgagctgagatcacgccattgcattctagcctgggtgacagagcgagactccatctg

SEQ ID NO: 403016 - DNA, 432 bp, Homo sapiens
tcagcagctaccattttcctaaaagttttcaatcagtagtatttccatcaaaatgctaattattgttgttgttgttgtgattaaagacagggtctccctctgtcaccccggctggagtgcagtggtgcaatcatagttcacggaaacctagaattcctaggctcaagagatcctcccaccccagcactttgggaggccaaggcaggtggatcgcctgaggtcaggagtttgagaccagcctggccaacatggtgaaaccccgtctctactaaaaaatacaaaaattagctgggcatggtagcatgtgcctgtagtcccaggactcaggaggctgaggcgggagaatcgcttgaacaggggaggcagaggttgcagtgagctgagatcacgccattgcattctagcctgggtgacagagcgagactccatctg

SEQ ID NO: 403017 - DNA, 424 bp, Homo sapiens
gtacattgtggaatataaatttgtcacaattaacaagtggtagagtgactatgtcacaatttagttgggcagaagggcaggggcataccaaggctatgtaaaacgattcacattagaacttctaattgtgtggaattaagaaaatttggctaggtggagtggctcatgcccataatcccagcactttagaaggccgaggtgggtggatcccttgagcccaggaatttgagaacagcctgagcaacatggtgaaaccttgtctctacaaaaagttagccaggtgttgtggtgcatgcctgtagttccagctactcaggaggctgaggtgggaggattaactaagcccgggaggcagaggttgtagtaagccgaaattgcatcactgcactccagcctgggccacagagtaagatcctgtctcaca

SEQ ID NO: 403018 - DNA, 583 bp, Homo sapiens
ctctcaaggacttggaatgtggggctgagagctcacaggggcatgtctgagtacatggcaggttctccgtaacagaacttcagatacttcaagacagccatcagagccctcaggaggctgcccttctcccagagaaaccccagctacttctgcaggagatggggaaagattttgggtcatgcaagtttctctcccctcttattgtctgggtcatatctccggcttttgggctacacacattgtttgctctttctcgttctctccccataaccaatgggaagagttctctagggacctcaacatctttctaaggctggtgggcctggctggcaggaatgaggactcaacggaaaggggatgtgtcaaatactccctactatccttcaccaaggtggaaagtccctgctatccttcaccaagatggcaagtatctagatgttcaaagcaggatgagctaagcttttggcaacaggagctgggacccctcctccaggacttttccagagaaggcagtctttaaccctgtgacctctgctgggtctctgtcacgcagcatccatcatcaagatggtcagctacttcc

SEQ ID NO: 403019 - DNA, 430 bp, Homo sapiens
taggagtcccctgggtcccacctgctccctgtatccctccacagtgcctagcccaatacatagctcacaggtgggctcaattcaggttgaacccaatccagagaaaaccaattgaaatacatctaatttaagctttgctctgtcacaggactgtgggatgggaagaagtgatcgcctcttcggcccagattccaggtaaatacgttcttccatttcaaaaggctccctcactggtcctggagaggggaagtagagctgctcgcccacttgggctagcgatggagcttatgaattcggagttttcattccacctggatctaggaagtcttttttaagagtctactgcgccagataatctctgttccccacaagccattctcttctgtgcctctaaaggataaagatctatttgtctctgtgtgtatgttac

SEQ ID NO: 403020 - DNA, 245 bp, Homo sapiens
gtaactttaagggaattatcaaaaggcatctctatttccaggtagattccctgagcatcctaacccctttaccctctccccaggtccatggttcagatttcagtctccacttccttcttggccatacatctttgtacagagaacaatacagatggctgtctgtatccccaagttctacatccttggattcaaccaactatggatcaaaaatatttgaaaaaaataccaaaaataacacaacaaca

SEQ ID NO: 403021 - DNA, 531 bp, Homo sapiens
tttttttatattgagtaggtttttttccattggagtattggaaaaaaggagttttctaggcatgtacttcttgttatatggaatactgataaactttgttttcttgctaaaattttagtgtgcacaggtagcttttgaagatgtctaatgcaaattaggctttctggactgtctagcaccctttgctttcaccctttgtgattatacttttttgtatttaatgcatatctatagaaatagtgattgttggccgggcatagtggctcatgcctgtaatcccggcactttgggaggctgaggtgggcggatcatctgaggtcaggagttcaagaccagcctgaccaacatgaggaaaccccatctctactaaaaatataaaattagccaggtgtggtggcacatgcctgtaatcccagctactcaggaaggctgaggcaggagaatcgcttgaatccaggaggtggaaattgtggtgagccgagatcgcgccattgctctccaacctgggcaacaagagtgaaactaggtctc

SEQ ID NO: 403022 - DNA, 332 bp, Homo sapiens
tcctgacctcaaaagaggaggtacctcaaagtccctctgagaatttcaccttcaaattcagaaatccctccccaggggagcccagaagcccaaggctgtgtgcttgcccgtttccagagcctcccagcacacgggcacccataatgtgtagacagagcaggtgctccgagaattcctggggaaactgaacaaaaccaccaaatgaactgttcgtccaagcccaggtccttggggaatctcacaccccacatccagtccaccagcaattcctaccagctccacctttaaaacacatccggaattcggccaggtgaggtggctcacgcctgtaa

SEQ ID NO: 403023 - DNA, 1016 bp, Homo sapiens
agaaaaagtgattggtgtcttttagaaaaatcacttcttcagtaaagggggagaaagtccaagaaaaatgtataaattcacagaaaccccagaaatcaagtttggtacatatcttttgcaggatagaaataatataggcataaagttgtctttcatttagaagatcagattcccagaatgactactcccattataaacaaccaaaaatactagttaaaatacagaaagattttagccatctgagttggttagctatgaaatccagtcctgggaaccctgatcttattctgggcactctaagatccaggggcaaaagattaagcctaggacaaagagaactaataagctcatccctcaaccccattaaactccactaggctacatcagcctaaaggtgagcaagaacaatacccattgtacaggatgggtacaataaagctgtccacattgaccatggctctgagtctcttactcagaaagacaacattttctttcatacaaatgtgtggccagaattcaagctaggttatatggaaatcctcaagaggccgggcgtggtggctcacgcctgtaatcccagcactttgggaggctgaggcaggcggatcacaaggttaggagatcaacaccatcctggctaatatggtgaaaacccgtctctactaaaaatacaaaaaattagccaggcatggtggcacacacctgtagtctcacctactcgggaggctgaagcaggagaatcacttgaacccaggaggtggaggttgcagtgagcctcactgcactctagcctcggtgacagagcaagactccatctcaaaaaaacaatccacggaaacaaccacatatcctctggaatctcaaagaattcttaaagaattctcaaagttaaagcaacaaagaaaataaactcacagagccaggcagggtggctcatgcctgtaacaccactttgggaggccaaggcaggaggatcatgagctcaagagatcgagaccatcctggacaacatggtg

SEQ ID NO: 403024 - DNA, 165 bp, Homo sapiens
tggggagctgtggtggaattctgggtggggctgaagggaactttcacattcccacacgttggagagttgagggtatacagcgttgctggcagaggagcttgaaattctgacattttctttcagccttcatctctgggccatggcctcctttctgtctgtctgtcc

SEQ ID NO: 403025 - DNA, 405 bp, Homo sapiens
agagttggaattaacctctccttccttcttgctcccagttaactttgtgcttgtaagttatgtgaaacattcattacttgagatggtaattatttacctaattgaccactctctcaactggatgcttttgaaagagcaggatcttactctctcttacagctccctcagcatggagtagtgaagagtgttctttaataccaaagggacaaagaaagctgactgggatcggtctgccacatgctagttgcttcagttatttttttgcactaaattattgtgtctctgctaatgtcctttttcctttcttccttccctcccttcttccttccttcttctttccctctctctctctctctctctctctttctcactcagtaagctacctcaaatctgttacttaagaga

SEQ ID NO: 403026 - DNA, 408 bp, Homo sapiens
ggcagatgagtgttaacagaattccttgtagaaacatgaacttctgtttaaaggctgtggattttgggattttaagagcctaggcagtggggaataaaaaattttcatagttatattcaatgtaagttaatggaattaagatttcatctctgaaactttacatttttagctttcgtgatctgtaattatcttttcttcccactttcatatgatgtaaatagagcctaggtagcaggagtttcctacctaggtattttacacagtgaatctgactcaaatgtagttggggcttttagaaatattgttaataaactttgagctaatagttgcgaactcaacatgctgaaagtttgtaattaagaacagtattggctgggtgtggtggctcacgcctgtaatcccagcact

SEQ ID NO: 403027 - DNA, 409 bp, Homo sapiens
actaagagttggtttttagaaaatatcaaattaacatgcttttatttagtcaactgtgaaaaaatagagaagattcaaataaataaaattataaatgaaagggaagacattaaagttgatagcacagaaatacaaataattttaagagactactatgaataattgtaaatcaacaaatcagataacctagaagaaatagataaattcttagacacatacaacctaccaagactgaattatgaagaaatagcaaatacgaacagaccaataatgaggaaggagatttaatcagtaatacaaagtctcccatcacagaaaagcccagaatctgaaggcttcactgctgaatgcttcttatggcatcttaggtatagaaatcatatatagaaaaccctaaagactccaccaa

SEQ ID NO: 403028 - DNA, 307 bp, Homo sapiens
ttttttaatagagacagggtctcactggagtgcagtagtgcaatcataactcactgcagccttgaactattggactcaagtgatcctccaaccttagcctccccagtagctgggactacaaatgtgtgtcatcacacctagtcaatcccgcttcatcttgcccaggacataaatcataccctgtgctgcatattatacccacacattagtcaattagttgctgtcttgcttatcagatcatcctgacatccaaccattgatattgtcgtggctcagtgatctgagataacccaaagcacatggtcct

SEQ ID NO: 403029 - DNA, 895 bp, Homo sapiens
ctcgcttcccctcagccacttggagtctggtcttttccatcaccaaaaagggaaggaggtaagggaattgagaaaagggaaaagagaaacacagccactatgactgcccactagctagaaatctggcaggcacggggatggtataaactcccaccaacactgtatatgagtgcctgtttccccacagccttaccagtagagtaggctcttgaacatttggatttttgcccatctgattaaaaatactatttttttggtatttatgtgtagtatagtttaaacatgcatttctaaattggaccttttcatgtttttaaaaggacatttttgtttctgttaagtgtttttcaaacaaccattgaatatttgttctagaggacattgaacattcgttacaactcaaatccaacaatgatgtgatcagcattacactaagcagttgaggtaaaagaaaagcaaagaattgaggtcagggtcattcaatttgctttgactaaagttaaatacccaaatgtctcactcaaatgtgagctcagaaaggtggagattatgttttatccattttagtattctcagcacagggcctagaatcttgcaggcacttagtcattaaggaatgaatactagggatgagattagctgttcttgggaatgcctctggctgagtacccagccaacattatgatcttcacaatctgtgtggcttgctaatgagacatggtcatttcttatatttcatcggagtacagccaccctaaagcttatcaatgaaaaataatctgaaatgagcatcgttagctatataaggtcaaggtctgggtctctcatgtctgctactgttcttgcatatggtgggcacttaataaattggatacattttgctgaatgaatgaaa

SEQ ID NO: 403030 - DNA, 450 bp, Homo sapiens
gaaattcctagcacacactgactaatagcattcagtatactttgaacattcagtgaaaagaattcctgtaattgttgatattggtatatttggtattttacttacttgcatatttttaaattagaaagaaaattcttaaaatgctgcatgccaaagtgtatctggcatgtcttctgtgaagtataaccatgacactctccagaaataatgtttgacactcttcccatgcagttcaatttatgaccttcctctagtcctgcagaaccatgtggccacctcctccagatccatttatgggatcttttttcctgtagctatgtagaacctgagaaatgtaagccctggaacctgggaagtattgacaggaccaacatttctctctctctgggtcatcatcgttaggtgtctgaaatatgagattagagatgggaactagaactttttaaagaa

SEQ ID NO: 403031 - DNA, 543 bp, Homo sapiens
gagttttgtcttgaagagcacagagagaaggtgaatgccacagaagaaatgctgcagcaggctttggtatcaggatgatgctggcctcataaaatgagttagggaggattcccccttcttctattgattggaatagtttcagaaggaatggtaccagctcctccttgtacctctggtagaattcggctgtgaatccatctggtcctggagtttttttggttggggctgattcaggagatcaatgatttgaggttaaaagttagtgaaatgggcagtgagagacttcagtatgaaaaaaagcatgaatcaaccaaagatgaactgacatctttaaaagaacaactagaagaaaaggaatctgaagtaaaaaggctacaagaaaaattgatttgcaagatgaaaggagaaggggttgaaattgttgatagagcttcaatctggaaatgacagaacaatcaccctttaaaataaggaagtgcaattcagtgaagacaggtttatgattcttagtatgagagaggaaggataatcttcaacatagtt

SEQ ID NO: 403032 - DNA, 379 bp, Homo sapiens
tgaatgaaattttttaaaattatatttggaaatataatgtgcataacatctggcgacactaaggtaaatttaacctttctttgtaattatgaatgatgactggcactatgagataccagccatgttctgagcaagaacatgtgaaggataggctagcattctggaaaagatgccataatgttgatgaagtcagcagaactagacagcagaactttatgatgatcagtttactctttcttcccaacttctctagcaaggattgtctcagatgtattccctcgttatcactgaagaggaccattctggaacctccctatgctgctaacggggtcatggtgtggtttgagtctccagtgcacattggaagatgaggaggagt

SEQ ID NO: 403033 - DNA, 258 bp, Homo sapiens
atatataataaaagtgctttcttcttgtctctggcttggctttttcatttccttgatggattcttagaaaagcagacgacttttaattttgataaagaccaatttagaagccaagtgtgattgtgtgcatctgtaatcccagctacatgtgaggttggggccatgggatcttttgtgccaagagctcaagtccagcgtgggcaacagagcaagacgctgtctcaaaaacaataacaaagaaagaaaagaaaagaaaaa

SEQ ID NO: 403034 - DNA, 568 bp, Homo sapiens
gtcagacttcattgaaagttgaaaatctggagcaagacaatgggtggaaaagcatgtcacaggaacatttaaatggaaatgtactttcccaactggaaaaagttttctaccatcttcccactggttgccaagagattgctgaagtagaagtgcgaatgatagattttgctcatgtgttccctagcaacacaatagatgagggatatgtttatgggctaaagcatttaatttctgtacttcgaagtattttagacaattgaatcctctgttgcagtctttttaaggggtgggccaatcataatgaagaggggcagtcaatatctgcacctttaatgctatgtaaaaaatttgtattatgagtcgacattttatttgtctttatacttttggaagaatggttaacttttttataatcttactcaggaaaactaactatttgttcattagaaaactatgaagaataaagaaacttaggaatgttaagcagggaatgtggtggtacatggcttaaacatcttttttggctcaagcaaaatgcaaaccattattcagtcattaagagtttagt

SEQ ID NO: 403035 - DNA, 183 bp, Homo sapiens
ctttcccattctctctgcctggagagctgatctgtatggactgtctcaatggacttctctgccttctggcttctttttgggtttggtcaatgggcagctctcccaggcagtctaaggtaaagaggagagtaaaggtgaggtgtttgctttttgtgattgtctacatgtgctgggaactacact

SEQ ID NO: 403036 - DNA, 914 bp, Homo sapiens
ttatgcctttacaaaagttaatttacattctctgtttaaaaaataatatttggtgaatgctatatagttgacagagcacatttacagaccttattaatttagtctttccaagagacctctcatgtaactggcattagccccatttttagatgatgaaactgcagtgcagatgttctggttctctcaactaccaagtggcataacccatggattttctaaaggtttcccaaatagatcacaacctaagggtgtgccaggggagcctaggggaagctaggctgggcattgaacactgatagtgcagaatccacatgcaaacaagatcgacagggtggataaacatatatgtgcattatccccatcccccacagtttagagccttctgcttttctgggggtttcagcctatgagacaaactataatcaggcttcattattacttttcaaatggccaagggttatctgcaatgttgatctaaaatcctaaaaaatcaccctgaagtcaggcaaggaacaatacttaaactccatactatggaaacaaggtatctagctggatgcagctggtaaattcagtcccatggacctttgggggtttattttccttagcagctgacaccatgtgtcttttgcatccctggtggtgcttggtgcttctgcccatctgggctcattgagaatagggatgaagatatgattttagggaatttctgatgggctggcatgccccatgtagtatgagttactatataaagtcatgtgactggcattttaacagaccttccagagcttatatatcccaatatatgttgtttcctttgagtagccccagcaggatactgcttagtttttccagtgccattggtgaaagcatttctggaactgtcttcaaagactagaaacactgactcccaa

SEQ ID NO: 403037 - DNA, 420 bp, Homo sapiens
ataagatttcataattcgagatcttacatttaaatctttaattcatcttgatttaacttttgtatataatggaagagtccagtttcaatcttaggcacttctcaaaagaagacatacatgcagccaacaaatacatgaaaaaatgttcaacattgctaattagagaaatgcaaatcaaaaccacaatgaggtaccatctcacactagtcagaatgactattactttaaagtcaaaaaaataacagatgttgctgaggttgtggagaaaagagaatgcttatatactgccggtgggaatgtaaattagttgaggcattgtggaaagcagtgtgatttctctaagaatgtaaaacagagctaccatttgacccagcaatcccattactgagtatatacccaaaggaaaataaatcattctat

SEQ ID NO: 403038 - DNA, 417 bp, Homo sapiens
gttccttaatttcccacaacagagacagacttagtgtttgccacagtgaagagtgttctagttccacctccaccatggctcatcaggtgactttgggcaagtcccttcaacattctgagccccttttcttttctcatttgtaaaatgacagtaacaatacctatgccattctccttgagatgccaaatgggctgatgacctccatcatagcttcttaccctgggtccatgggtaggcttggatgggagtatcggtcctttcgaggcatatttaagactttatgtctgtgcatgttttggttggggtagaaggattcacactttttatcagtgtgccagcagagttctgaatattaagaatcaccgatgcatgcaaaaacattttgtgacctgatgctgtacagatgtaagagtaaaa

SEQ ID NO: 403039 - DNA, 663 bp, Homo sapiens
tgaaattaaagagtagcaaattaagtgctaataaaacgagatagtcacttacataattcattgccatgggaggtcacagaggcaaattttgtggctacattaaatatggggctggataattttatgaccgctaatgatatttttagcagtcaaggctgatactgtgagagaagaaatcctattacattctccagtagatggtttgcagggacctctggcaagaggtttctgagaagtgcaagagcagaccttgtgagttctaacctttggtgtactcaaaattggtttttaaggggaaagttcccaggcatcccattcatacctcagtcccatattttcttgtagagatccaaaagccctttctagtctgaagcagtggagaaagacattgcccagaattaaatcctttctggtctttgggaaccactcgacttatttatcgtatgccacccgtgcgtcaggtccttcgcttggagttttaaaaaatcttttggggacataaacatttggacacatcagtggcattctgagtgaaggggatgtactaaaggtggaatgcagagtttcatggaagcacgaagaagcaaagggatgtctcaacctgtgaggttcagggaaggctcccagagaaggtgacatttgaatcgactcttaaaggatgag

SEQ ID NO: 403040 - DNA, 239 bp, Homo sapiens
tcccacaaagaaaacccctgcgccagtatgtcttcattgaataattcttccaaacatataaggaagaaatatcaccaaccttacatatagttcaccagagaatagaagaaaagaaataatttccaattattttatataaagccagcatagccttcatattaaaacttgattatgaaaagcataagaaaagaaaatctctcttatgaacacagcaatctctttcacagacatatactcct

SEQ ID NO: 403041 - DNA, 489 bp, Homo sapiens
gcaggcgattactccgagtctctctgccagagcatgggccacttttctgcccaatcagctcatctgactccccaaagacacgccttctgagtgccccaggaccacaccacccacgtgactcctaagtctttgaccatgccagggctgatctccccagtaaaggccccattagtcactttgtagcagttctgcggagccacagcaatcttgggagctagcttctgccgggccaactcgttatacgcagtggcgagagcacaaatcaccttggtgtcggcaggcacagtggccgcgttctgagtgccgatgagctcccccagacatttcttccgcccgttcatcttccagttcctccccacgaagaacttcctggagggcgccatggcgctggagctgaggcgctgtaggtcagtgtcagcgcctaaaacgggttttattaatacttggcaaggttgttaggcggattaaatgagatcttgtaactacagt

SEQ ID NO: 403042 - DNA, 550 bp, Homo sapiens
gaagggcctgggcttacttggcatcttgtcaggagacttttcccttcttgctttgtccatgctgaaagggacaggaaaggtggaaagagcacatcgggtttttacagcctaattgcatgtctcatcctggctcttgagtagaactggctggcttacttgtaattcatcatgaaaaacacattcataatgtttttggaggagtagttcacttcgggaaaggaccatgagtcttgaccccattggtattaaggataacaaatgactcacaaataatgaaagcaggaagaaatttttaaaaagcagaatgcattttaaaaaatgacctcaatttagactactgaaggacttccctcttgttatatctctgtgtgtcatttattggaaagcaaaaaataaaaaaaaatctgcattgtacacaaaagtgcccttgtaaccagaattagtttagtgcagattaaaggcatagaaagaaaagtaaaatactgaattataaggtgaattctacaatgcaatcttggtggagttatttcaaaaggataattttaaaacg

SEQ ID NO: 403043 - DNA, 560 bp, Homo sapiens
gagactccgtctcaaaaaaaaaaaaaaaaaaaaaaattagtagtttatgtcaccaaaaatcagataacataatggggaagaaaacattccttttttaataggaataaagccaaaatgtttaaataaaccttaaccataaataaaagatctaaataattgtggagtccgccatgtagataagatgttacccttggaaaatgtgatgcagagacatgaagagataatggaatgtattataactctatattagttacaagtgcacttcttggaggaacgcatgcaatttattgaaatgaataacaacaaagtgggccgggcacagtggctcatgcctgtaatcccagcactttgggaggccgaagtgcgagaatcgtttgggcacaggagttcaagaccagcctgggcaacataatgagacccccatctctaaaaaggaaaaagaaaaaaaataaccaaaatgaactttgagctttttatttcaaaataagttccaagtagttgttggggctgggcacggtggctcacacctctaatcccaactctggagatagaggtggaaa

SEQ ID NO: 403044 - DNA, 434 bp, Homo sapiens
gttaatttacatcgaaccttatgtctgtcgcccaggctggagtgcagtggcacggtcttggctcactgcaggctccgcctcctgggttcacatcattctcctgcctcagcctcccaagcagctgggactacaggcacctgccacctcgcctggctaattttttgtatttttagtagagacggggtttcaccgtgttagccaggatggtctcgatctcctgatcttgtgatccacccacttcggcctcccaaagtgctgggattacaggcatgagccaccgcgcccagccacagatggactcttacaactgttacagatagaaaccccctagggctatctaggctgtgctgattggccccgagataaccctttgtgggtgccgtttatgggtacttctgctgctgatttttctgttttggaaactttcctgtccc

SEQ ID NO: 403045 - DNA, 437 bp, Homo sapiens
aagattcccagcaaacacgagaggccgggagagacgcctggaacagatgctccctcgcagccctcagaaggaaccaactctgctgacacctggatctcagacttccagcctctaaaactccgagacaatgcatttctgttgtgtatgccacttgatttgtgggactctgttatggcagccccagcaaatgaatacaccaagtagcttaaataaagtcagtatcttcctttgatcattgggaataatcataggtgagtggtctgcattattggctatgtctagcttaggaaaaggacatcacaaggagaaatattctttcccaaaccaagtgaccaggcttccaagagcttctacatagagatgcatccaactagaagtggggagtctccctgctccagctcaggtgatgaaaaaattctggtcaactctgactgcca

SEQ ID NO: 403046 - DNA, 341 bp, Homo sapiens
aagatgcatattggtccaaaaagtaatagtgactatattttaatagaaaacactaatagcaagtttcaaagtcaccattttgcctatgaggcataatgacaaagttagtccattaaacagtagactaacaggagagtcgctattaaatctttttaacacacaaagaattgcagaaagaagtgagtggcttggaaaagagtgtctgagaacctaacgacatttatttaccctggcagagaattgcatgctacccagatcaaagaccttaatgataaaaatgatcttcacctgaccaagacctaaggcgtcctgaaggccaccgagaatacagagcttcatcc

SEQ ID NO: 403047 - DNA, 1682 bp, Homo sapiens
  misc_feature (1)..(1): n is a, c, g, or t
  misc_feature (30)..(30): n is a, c, g, or t
  misc_feature (37)..(37): n is a, c, g, or t
  misc_feature (42)..(42): n is a, c, g, or t
  misc_feature (100)..(100): n is a, c, g, or t
  misc_feature (156)..(156): n is a, c, g, or t
  misc_feature (167)..(167): n is a, c, g, or t
  misc_feature (191)..(191): n is a, c, g, or t
  misc_feature (195)..(195): n is a, c, g, or t
  misc_feature (201)..(201): n is a, c, g, or t
  misc_feature (216)..(216): n is a, c, g, or t
  misc_feature (232)..(232): n is a, c, g, or t
  misc_feature (245)..(245): n is a, c, g, or t
  misc_feature (257)..(257): n is a, c, g, or t
  misc_feature (280)..(280): n is a, c, g, or t
  misc_feature (283)..(283): n is a, c, g, or t
  misc_feature (290)..(290): n is a, c, g, or t
  misc_feature (314)..(314): n is a, c, g, or t
  misc_feature (317)..(317): n is a, c, g, or t
  misc_feature (506)..(506): n is a, c, g, or t
ngaccaggagcgggagccgagcctcgcggnccggggnacggngccgcctgcccctccccggcagtgcctcccgaccccctgccctccgctgggacatggnctgaggccccgcccgccgcccgggacccctcccccacgctgcccccggaccctcgncccaggaccgnggggtctcttcccggccccgccgnccgncccggngagaacaggcccggngggcaaggcggcggcngaccgagggaggnctggcccggcancggggagaagggtgcggcgcagnccnagtttcncaccttttatcctggcccagacgnggntggggcggacgggactctcgcgctctgcctcctcctcttgcttcatggagccatgcgcctgggtgggggctcccgagagaagctggcctgcgggcgggccggacgcgctgcgcggacgggacggggcgaaggaggccggcaggcggaggaggaagcggcggggcggcggcggcggcggcggccgggaanaactagaggtattccccgggcggctggaggactgagtcgagccgggacccgagtcctccggtatcccagcagccaccggaggcagtgaggtaatggaggaagaatgtagggagtcctccggtggaccacactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagatatcgggggaaagccgcgagaaggccagcgtccctcgctgggagcagagctagccgagtagggcgcccggctgtcaaactggccggcgcagtgcacgctgggccgccccggagcgatcgcagagcccgtcgggagtcgtagtccgggacgggcccgcggcatcgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctcgcctgaccggccgcagccttggataccagccttaaatcgagccgactacggcccagccccgcccgcggcgaggtgcgcggggttcggtgcgagcccctcgcccctggccgggccagcctcttgatgcaccggggacgggcgcgcccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaacttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcgagccatgttctagagcaatgtctttcttgtattaaaatacagccccatgctcacaaaaaaaaaaa

SEQ ID NO: 403048 - DNA, 1618 bp, Homo sapiens
  misc_feature (1)..(1): n is a, c, g, or t
  misc_feature (30)..(30): n is a, c, g, or t
  misc_feature (37)..(37): n is a, c, g, or t
  misc_feature (42)..(42): n is a, c, g, or t
  misc_feature (100)..(100): n is a, c, g, or t
  misc_feature (156)..(156): n is a, c, g, or t
  misc_feature (167)..(167): n is a, c, g, or t
  misc_feature (191)..(191): n is a, c, g, or t
  misc_feature (195)..(195): n is a, c, g, or t
  misc_feature (201)..(201): n is a, c, g, or t
  misc_feature (216)..(216): n is a, c, g, or t
  misc_feature (232)..(232): n is a, c, g, or t
  misc_feature (245)..(245): n is a, c, g, or t
  misc_feature (257)..(257): n is a, c, g, or t
  misc_feature (280)..(280): n is a, c, g, or t
  misc_feature (283)..(283): n is a, c, g, or t
  misc_feature (290)..(290): n is a, c, g, or t
  misc_feature (314)..(314): n is a, c, g, or t
  misc_feature (317)..(317): n is a, c, g, or t
  misc_feature (506)..(506): n is a, c, g, or t
ngaccaggagcgggagccgagcctcgcggnccggggnacggngccgcctgcccctccccggcagtgcctcccgaccccctgccctccgctgggacatggnctgaggccccgcccgccgcccgggacccctcccccacgctgcccccggaccctcgncccaggaccgnggggtctcttcccggccccgccgnccgncccggngagaacaggcccggngggcaaggcggcggcngaccgagggaggnctggcccggcancggggagaagggtgcggcgcagnccnagtttcncaccttttatcctggcccagacgnggntggggcggacgggactctcgcgctctgcctcctcctcttgcttcatggagccatgcgcctgggtgggggctcccgagagaagctggcctgcgggcgggccggacgcgctgcgcggacgggacggggcgaaggaggccggcaggcggaggaggaagcggcggggcggcggcggcggcggcggccgggaanaactagaggtattccccgggcggctggaggactgagtcgagccgggacccgagtcctccggtatcccagcagccaccggaggcagtgaggtaatggaggaagaatgtagggagtcctccggtggaccacactccttctagcgagccgcggaaaccatagagatcagggctcagccggagggccggcccactgctgtcacgtggcctccatccgtgcgctttattggctggtgctggctttacggggttgaattttggacgctgcctgccattcgtgggaccgagtttcaggcagctggaataaagagagatatcgggggaaagccgcgagaaggccagcgtccctcgctgggagcagagctagccgagtagggcgcccggctgtcaaactggccggcgcagtgcacgctgggccgccccggagcgatcgcagagcccgtcgggagtcgtagtccgggacgggcccgcggcatcgtccgcgacgcagctcgggatccgggtcggggtgtcggccgggttgctgccgggcaccgtcgagcgttagccacccagcattgagctgccagcggctgttctccctaagcaccctcgctcacgtcgcctcgcctcgcctcgcctcgcctgaccggccgcagccttggataccagccttaaatcgagccgactacggcccagccccgcccgcggcgaggtgcgcggggttcggtgcgagcccctcgcccctggccgggccagcctcttgatgcaccggggacgggcgcgcccatccgactcttcgaggggcggcagggccccatctgtgtctttcgctctcgagcccccagctagagttggcttcagcggaatacctactgtgcgggattattcaacaagccgattgatcacattcttcagctctagcagtgcaaaggcttcactgaaaaagaacattacaacttttttgaaagaaatttgggggtaaatttaattttaaatactgatttttgataacatttgatcttatgacagcatttgtatttttaattacagataggattacactaaaagtcatttctgacctgctcccttacccttatggctaaaataaactgctaggccctgaagcaaaggcga

SEQ ID NO: 403049 - DNA, 406 bp, Homo sapiens
  misc_feature (195)..(195): n is a, c, g, or t
cgggaactgcaaagggcagagaacgggggttgggagcatccatacgccagctctaggttgcccaggaacgcaaagcggggctgagcggacaaaccagaggcaaccccaggactggacactctctatggcagctaagattctggaggctgggagtggggcatctcacagaccttctccatctaggagcacccactncccactcttttgacctcatttcctgtaaggtggtaccataaaagctttttgaggccagagcacaccaaatacctgtgactactttattttccaaagagaaagtcagcagcagcaacatccagatgaaatactctgatcttgagagatgcagaaatcgaattatgtttctgtctcttcctttcctgttacagtaaaaaggttatttgtccta

SEQ ID NO: 403050 - DNA, 228 bp, Homo sapiens
gggacaaatgagaacatggggacaagttgtgagatgagggacctgtggctctggaattgtatttctgggaaactgcaaggaagctgtgtgtgtgtgtgtgtgtgtgtgtgtgtctgtgtgtgtgcaagtatttgaaagaaactaaaaatagagaaattcaatcatactagtatctccaactgcttctgagtctgtgactagaccaatgataataaatgataaagaact

SEQ ID NO: 403051 - DNA, 749 bp, Homo sapiens
caggtctccctacattgtcctggctaactattcataagcactaatagtgtaccacagtgttgaattcctgagctctagtgatccatccgcccaagtaggtgggaatacaggtgtgtgccactgtgctcagcttataataaattagtttctaaaagcaagtaacaaaatatgaaatcaagattggtgtaattatgaattacccgtttggtattcaataaagacacctggagcagatactgcatttgaccaccctcaacaccactcaaatccctgttagtcagccacatgaggggtaacacatgtgaaaggatggctacaaagtgaggaaggctgggattcaattccacttctgcaacttccttattatgtgataaatgagtgaaatgagtaaaatatctttagaattaaatgagataatgcctggcacctaatggttatttaataaataatataacaataagtctcagttcacaattcaggacagtaatagaagtgatatgacaatgctgcacacaattaaatgacagaaaattcctatcttagaatttaaaataaagttaatattaaagcaggtaaaaatagtaaagaaaagctgacaacagaggtcatttaaaaataatctaaaattttcaggctaggcacggtggctcacgcctgtaatcccagcactttgggaggccaaggtaggcggatcacctgaggccaggagttcaagaccagcccggccaacatggtgaaaccccatctct

SEQ ID NO: 403052 - DNA, 803 bp, Homo sapiens
caggtctccctacattgtcctggctaactattcataagcactaatagtgtaccacagtgttgaattcctgagctctagtgatccatccgcccaagtaggtgggaatacaggtgtgtgccactgtgctcagcttataataaattagtttctaaaagcaagtaacaaaatatgaaatcaagattggtgtaattatgaattacccgtttggtattcaataaagacacctggagcagatactgcatttgaccaccctcaacaccactcaaatccctgttagtcagccacatgaggggtaacacatgtgaaaggatggctacaaagtgaggaaggctgggattcaattccacttctgcaacttccttattatgtgataaatgagtgaaatgagtaaaatatctttagaattaaatgagataatgcctggcacctaatggttatttaataaatgacagctgaatctgaatcaagtgaagaaacaaactataaatatgttcaaattttaatataacaataagtctcagttcacaattcaggacagtaatagaagtgatatgacaatgctgcacacaattaaatgacagaaaattcctatcttagaatttaaaataaagttaatattaaagcaggtaaaaatagtaaagaaaagctgacaacagaggtcatttaaaaataatctaaaattttcaggctaggcacggtggctcacgcctgtaatcccagcactttgggaggccaaggtaggcggatcacctgaggccaggagttcaagaccagcccggccaacatggtgaaaccccatctct

SEQ ID NO: 403053 - DNA, 201 bp, Homo sapiens
tccaggctgtgtttaaatttccagttgtttcaggtgtcataaatgttttcagttttttgcaagactgcttcataagtgataattctatcagaaggcacacataaatagcctcctcggtttttgtgatgttagcagctatcagtgcttaatgtgtagattcattaatttattagctgttgtataatcatgatttttaactct

SEQ ID NO: 403054 - DNA, 261 bp, Homo sapiens
tggccatctgttcaatatacgaagtactacatgccattaagacactaaattactatcagatgcaaaacaaaaaaaaatgaattcttacatcttgtgtcccaagcatgtacttatattagaaaatatgaaataaaaattcctctcagaagatggaagttatatgttatctgtgtgagagttatcttcagttgtaaaatttcaaattgcacttattctgttttatttccatgccactgggtgtgaaatttatgatatggagtt

SEQ ID NO: 403055 - DNA, 419 bp, Homo sapiens
ggctcagatgagcattttgcagatgaaatataaatggaggtgggtgggtaagggctgtgtaaagacaccagtgctggaaatgttctggggggctggggtagttttgtgtgtgtgtgtgtgtgtgtgtgtgtgtgtgtgtgtgagtgtatgtgcttgaccaggtcgtctagtcaagttgtagtttccagtattgcccttgttctcttctgtagtgttaaagaaggatgtttatttttgactatatagtataaataaaactagacttatggacatgcaatatctatcatcatgcactaggatgtcattttatcgattaacactgtgtgcttttgtatggaaagaatatatataatttcatagtataaatagtcttatatattgatttgcacttacgtgatacacctgtgctctctgtgcgg

SEQ ID NO: 403056 - DNA, 409 bp, Homo sapiens
  misc_feature (409)..(409): n is a, c, g, or t
ggctcagatgagcattttgcagatgaaatataaatggaggtgggtgggtaagggctgtgtaaagacaccagtgctggaaatgttctggggggctggggtagttttgtgtgtgtgtgtgtgtgtgtgtgtgtgtgtgtgtgtgtgtgtatgtcatgtgtaacatgtgtgcttatagaagtgcttatcgaatctaatagtgactactgctaatgcgctgtatgttgtgcaatattatttattatgaatgatataatttagcatgttgatcatgatagctcgttgaatttgcgccatttaatatgaagtcctgttaatcctgacttcagtttttggggatacttatagagcttgcccgttcaatctctggactcacatttagttactgtaagtatctacttgattttgcccn

SEQ ID NO: 403057 - DNA, 692 bp, Homo sapiens
ataaaggtgaaagtagctctctagtagcctgtgacagggaggatcatcagacaggtgtttacttccttcctggattacttttccaggagacacccagatgtggcaatagctcttggggttttgggctgacgtacaggagctgaagctgtgatgtcgcgtgtccgtgtccttaggacagtgttaagtggggagctgcccccatcctgcattctcagcagatagcaggcatgtttgccagccggttggttaaacaagctctgaaaacataaacattgatggttttggtggtttcatgtgttgtcgtgtgacgtaagcagatgctaccacagcagagccagaggtgagcaagacgtagggcagagaatcccactcacagtaacacaggaactaaaacagctttttaaaatgtgtttgcaggccaggcatggcggctcaagcttataaccccagcactctgggaggccagggtgggaggatcacttgaggccagaaattcgagaccagcctgggcaacatagggagacctcaaatcaatgtttaatgacctgggtgtgggtggtgcacacctgcagtcctggctactcaagaggctgaggtgggaggatcccttcagcctggaagctcaaggctgcagtgattatgccaccacactccagcccacatgggtaacagagcaagaccctgtctctaaa

SEQ ID NO: 403058 - DNA, 294 bp, Homo sapiens
ttcatggagtttataattctaataaaaatgaatcaaataatcaaatactattactattctctttttcagatggcatgggtaacactagcaataactgaaacataaaattaaaagttaaaaacaaagagaaataatattcttcaggattatatattagctctaagaagtgatacattgcattgtttttagtgagatggagctagaaaaagcagtggaaagagggaaagtccacttaccaaaaagataaaaagaattaaaccttggatactaaacttagagcacaagttttatgcc

SEQ ID NO: 403059 - DNA, 463 bp, Homo sapiens
gaactggcaccgcctgcacattcactcatccaatggttaagggtgccaagagtggctcagaagctccccatggaagaactccaaaactctagctttcttctgcctggcgacaccctgcctttctgatctatatttccctcatctaaaagtcacctttctactagtgctttttcctcacaatctcacaacaccttgcgggttcttatctcctcctttgctcttgctcccctccctaccaggggaccccctgccctcatcacagtctgattaaagtccttcctctttcaggaggcctccccaactactcaagcctgtaaggggcgaggactgagcagcagaaaacatcctactcagtcagcagcaagccacactcatgtaagaatgactcgcaaaatccttagtcccacaggatcttttgctgaatctcctcttaaatgcctttcaggtctaaatgcctgtcctc

SEQ ID NO: 403060 - DNA, 664 bp, Homo sapiens
gtgggtgttactagtaacagtacactcttaaacaaataaggcaggtgagggatgttgtcagtagaaaatatattgatttagtttttatttcattgaattttttttattttaatttttttaccaatggggtctcattctgttacgcagctggaatatgatcatggctcacttaagtctcaatcttctgtgttcaagcattcttcctacctaaccctccaaagtacctagaactacaggtgcacagcaccacatcaagctaattttttaatttttgtagaaatggggtcttgctatgctgtccagggtggtctcaaactccttgcctcaagccatcctcccccctcaacctcccatagtgctgggattacaggcatgcatcattatgcccagcaatttgtgttttttcctaacctgcagaacaaagtaataagcctgtttgtttcaagatctccacctagataaacatagagaattctaaacattaaatatttctgaaacttcaacctaggaaactactgcattttttagagtattttgtcctcttctttttgaatgttttacttttttttctcacctgtattgtgaaaagaaaaccagaaagcaattatttcttccttctatgcccatcccttgtctttaatatcatctttgaaatagtgacacc

SEQ ID NO: 403061 - DNA, 149 bp, Homo sapiens
tcccgggatcctatgtgcatccagcctttttctattatagaaactggactttatttttatccccctttcactatttctcagttctcaatgcaaaagttttactggcatgattactcaataaacaaataaataagtaaataataaagata

SEQ ID NO: 403062 - DNA, 610 bp, Homo sapiens
tgaagatgtttaaataaaaagaagaaatcaagcatttatcctgctttcctggtttgaattgtatttcagaatacacaaatagttgagtaggaaaagttacttttaatggaagaattacagcttataaatgcagaatgagtgtagagtctaaaaatcaccattccgtaggccctaatgaattaatgggtgtaggcagtgatcattggtagctgctaaaaccattaattaagtgaaagattgatggggagctttataatgaatcaatcaggctgacaacacctgaacctgctgctgaatcctaacatcagaaacagtgagataaccagacattatgtatctcccaatgtcagcactaggaagttcatagcagagcttaaagtgttcttgccaaaaagaaagaaaggaaaaaataaaggaagaagtaatcaaccttgtagatctaattacagcttagaaaaataaaaagaagattaaaggaacaagttaaagacatcaagaaacatcaatctgctaaatccagattgtgtgaaattgtataggacaaatgacttggtttctttgacaaatgaatgacatgaaattaataaaggtgagaagaccccgtctctac

SEQ ID NO: 403063 - DNA, 221 bp, Homo sapiens
aatattatgctccctcataactggatctccctggtgtttttacctccttgagttgtccatatggaaccttcagcaattcaccagttatagttcaagattttctactccagcactggttcctaaggtggtttcagtagtgagtctctgttcctgtaagccataaattcccatattcacttctctatctctccaatcttgggggcagtggtttgccctatgtc

SEQ ID NO: 403064 - DNA, 385 bp, Homo sapiens
ccctgtctcaaaaaaaaaaagttaaatagagatggtatctcactgttacccaggctagtctcgaactcttggcctcccaaagttgctgggattacaggcatgagccaccacgcctgccctccttaatttacttttatgtttaaagtaaatgtcttatagagagcatataattggtagctgggtcttgctttttttttttttttccagtctcacaatctcagtctttaattggagcattaatccatttacatttaatgtacaatcccatatggctggatttaaatctgccatcgtgttacttgttttctatttgttttttgtttccacttccatctttccctgactcatttaatttttgtagtattttttagtattccattttatc

SEQ ID NO: 403065 - DNA, 401 bp, Homo sapiens
ttggcaggctgaccccccacagcaggctattaacataggcatccttcacgctcacacccaggcgctcgcttctcatcttcaccctcttcccggtttatcttttaccctcagactccaattcccatctttctgccacatttacatctcaagccaggcacttcccctgagccaggtatttatctccagctgtccccttgaagcccacagactccttaaggtcaccttgtccacagtgagctcttctgtgcaaaccaggcacatgagccagagagctagccgcccacccgaaactggtccctggacccctccctctcctgatcatccactatacccaggctgacaggaagtcagttttactgtttatcaataaatcaataaatcccagaatctctccagctcta

SEQ ID NO: 403066 - DNA, 441 bp, Homo sapiens
cttcaaataccacagaagccgcccagagtctcaagtccaccttggctccactcccacacccaacaaggagctgtcccttcttcttccttcccagcgagggggtatttagggtacagctgtctttgagaggagcacagctcagcgatcctcagtctctgcaccagggtgctccccagcagaggggactgctccacggatggtggccttggacccctggggtccagccctggcctctaggctactgtgaacctgcccatgggtgagggtcccctgcttcctcctggggttttcatgctgtgggctcggactccctcacagcaatctgtgccatcctagggtagggcaagaggaggttggactggggagaccccgcccgctgacaggaagtcagttttactgtttatcaataaatcaataaatcccagaatctctccagctcta

SEQ ID NO: 403067 - DNA, 407 bp, Homo sapiens
aaaacagaaataatgtacaaatcataaaaaataacaaaccatctagtaaaagaagggcatgggagtgagaaaactgaatcctgaattccaggccaccaaaccctcagagtccattcattcagtatattatactagagtggcattctacttcaatgcttgagatgggcaagagcaatcaattcctacagattaccaaaaaacattccccccaacagtctattggtttgctagacatggtaaacaacccactcctggaaagactttggcaaaggccacattggtttcaggagacacagtttgtgaattacgatgatatcttgtgagtacaggcagaattaggaagctttagtttgagaataaaatttatgtgtgtgtgtgtacgcaatgtcactccttcacccaagcta

SEQ ID NO: 403068 - DNA, 554 bp, Homo sapiens
aaaacagaaataatgtacaaatcataaaaaataacaaaccatctagtaaaagaagggcatgggagtgagaaaactgaatcctgaattccaggccaccaaaccctcagagtccattcattcagtatattatactagagtggcattctacttcaatgcttgagatgggcaagagcaatcaattcctacagattaccaaaaaacattccccccaacagtctattggtttgctagacatggtaaacaacccactcctggaaagactttggcaaaggccacattggtttcaggagacacagtttgtgaattacgatgatatcttgtgagtacaggcagaattaggaagctttagtttgagaataaaatttatgtgtgtgtgtgtgtgtgtgtgtgtgtgtgtgcacactgcattgcatagaggaaaggaatgaagacctttgagctatgggatggctcaggccaaagtttgtgtgggctttgcctgcctggcattggtccccacccctgccacctccaggagacctgggggtggtatagataaacagcgggtcaccgag

SEQ ID NO: 403069 - DNA, 349 bp, Homo sapiens
gtgtgtgtgtgtgtgtgcacactgcattgcatagaggaaaggaatgaagacctttgagctatgggatggctcaggccaaagtttgtgtgggctttgcctgcctggcattggtccccacccctgccacctccaggagacctggggagacgccctggactgctgctccctcttgtctgctcaccagttgaagacttctgttataccttattatggaggaaaacagcctgtccctgtgggtttgctgtggattcaacaagctgcatttgtttctcccaattctgaaacattacaaaaagcaacagagtgggcaggtgactgcttcctgggaagggagccacaagtcttaaac

SEQ ID NO: 403070 - DNA, 325 bp, Homo sapiens
catcactaaagtatatatttctattcataaattcttactgtgtagaacaaaaaatgggaagaaaaaaacctctgggaagcacaaacagctgtggaactagttactcttattgttttaatctactatgtctaacaagactcgtgaatttatttccaagtccatagtgaactatgtgcaaattatgtggtgagaggctgcctacacatgctgaaagcagagaaaagtaaatgttgccagcctaacagtaaagtaagatagagggaaaaaatatgaagagtaaactgaagagctcaaaaagcatagcagcctgagagtaaagggggca

SEQ ID NO: 403071 - DNA, 404 bp, Homo sapiens
cctcatcttccacttatttatgagctgtgtgtcactgagctttccaaaatataccttttgttttcacagcccattcttctcttatcctgaaatgaacttctcttctatgcctctgacacctactcacgtatgaatgtcctgctaacacaccacttccgccaggacccaagtttgctcatgaaccctcttgcccattccagtggctacttcagaactcgccagatctttctctcgttcccatgttattgatctgccgtctttgtttgcttttcacactccttctcttatccaagaaagattttcacagcatcacactcatttaaatgtctatagctttagttctagactagtttatcttcttgctatatttttagagacaaatttccatccaaatttactatgca

SEQ ID NO: 403072 - DNA, 405 bp, Homo sapiens
ctctacaatccttaaaaaacatgcctcaccatttaagagaccagcagcaggccttcagcaaagcccacggtctaggcagcctttgtaggcctctgggattgtggtgagaaaaccttatccctctcttatttcctgataactttacattttagaggtgtctggaaagaaaggtggcagaaaagcagcataacctgcttgacaagtcctgtacaaacagaagtccaatgaggctgctgctctggggttgccaagctcaaggaagccaattgtagtgtgcacaaaggtgcaagtcaccaaggcctcagagagctccaaggaagcctgtgcaaaggcaggatttagagttctaaggacgggttgtccagcgcagcccagcagagaacctaggtccataactgtggactc

SEQ ID NO: 403073 - DNA, 149 bp, Homo sapiens
ctccatctttgtaattttggatgactttgactttagtcataaaaatacacagatggcaaggttatcttatttaaagtcactcttttagggaactttttttttttcactttaaggcaataaaagcttacaggggtataaagaacgtggat

SEQ ID NO: 403074 - DNA, 277 bp, Homo sapiens
actctccccaaacaggagggaggcagggcaaaggtttatgatcttcttagctaagcaactggtggctttaccagttgttctaaggaaacaaaatttcaagcaacttctgcagatgaactttccaggatgaatttcagctgctttatgtgcataccctttccactagttagtaaaaatgaccaaaacacgactgttgcaagacttttctctctaaatctgtggttctcaagtaggggtaattttgcactcaggggacatttggcaatgtctggagaaa

SEQ ID NO: 403075 - DNA, 443 bp, Homo sapiens
ccaagtcgctgatttaggtgtgagtcacgacatcattttattttttgcatttttagtagagatggggtttcactgtgttggccaggctggtctcgaactcttgacctcatgatctgcctacctcatcctcccaaagtgctgggattacaggcgtgagccaccgcacctggccgtgttgttgttcttcaggtacagcagttcttcatatattctggatattaaagcctcatccattcatgatttgcaaatattttctcctgtttcatattttgccttttcactctgattgggtcctttgatgcacaaaagttttaaagtttgatatagttccatttgtctgtttttgcttttgttgcctgtgcttttagttttggattgggaaaccgttgcctagtccaatgtcatgcctttctccttgtattttcttctaggagttttatact

SEQ ID NO: 403076 - DNA, 443 bp, Homo sapiens
cccgtctctttgccgttaggcagggcctgtggctggttctggccattgggtgtgactggaagtggcctttgtcacttttagcatgaaacatttaaaagtcaatgcatgactctccatcttactccttcccagttgtggagactgaagaggtcgtatgtactcattggtgcagctacaagacagtgatgccttctgaagtctgggttcccagtgactacgtctatggagcagagcccttctaaactataatgaacatgtcgtgagccagaaataaacttgtgttatgttaagctactgggatttgggggactgtttgttccctcagtacagtctagactaacctgacgtattaacataagtgtctacctaacacaacatgccaaccatttaattatactcaactcaattcaacctgactcttccttagctggatatcaattata

SEQ ID NO: 403077 - DNA, 270 bp, Homo sapiens
aattgccaggatgtccatttgagcaaagcccttgattaagtacttctggatacttgacaaacacgcagctattacattgcctaggtctcatgaaaagagctgatattcttgttggatgattctgtttgaacagtagaatctggtataacaattttgggaggcaatagaacttgcagtgtcagagtcttgagttgcagtactcttcattatcagtcccaacattgacatatatatattgattatagcaaacaatttaaaaagccacttaag

SEQ ID NO: 403078 - DNA, 518 bp, Homo sapiens
tcctcccacctcaacctctcaaattgttgggcttgcaggcataagccactgatcatgacccagtaaactgttctgaatgataaccacaaccatctctgggaggttaagggcatctgttcaaatctcttttgctattacaggaaggcctgtggagaagtttgagaagctggggtgttgatcttcctaagtgtagacaatgtgagcaggagcagagaaaacagagggtgggtttttccctatgattggcagcaaccatagaccaaagagatttaggattcaaaggtgcttgtgtaaggcactacaggggttctttactccatgggataaagtgattctcataatccctctgatatagatgttatattatccccattccctctgatgtagatgttatattatccccgttttagagatacggaagctgaacttcagagtggtgagcaatttccgtaagttacacagttgatcatcagcaaagaaaactgagtatggttggaaagactaaaggctcacaagac

SEQ ID NO: 403079 - DNA, 701 bp, Homo sapiens
aacctgcacatgtattcctgaacctaaaataaaagttgaaattatttttaaaaaagaattactatactcttaagctatgaaagcaccacaactaataccaactgttataaacttaagctgttaaaactatcccatctaatatgacattacgtaaatctgaaataattaaaagataccaattttggtgaactgatcatcttgtaagttgaaaaccctcacagaactggctttggtgatgtgaattttgagagctgatctgcatttatttaaccagtgacctataatttgacaaacaagcctatttctatatggtattccaaacagtcccacaataagtattctcttgtatagaactttgtgtagcccccagttattttcttataagtaatttattccaagaagtggtcatgttgggttaagaagtgtgtacattctaacggagtttaatatgtactgtcaagttaaagattgtatcacttatcctctcatgccaagcccagtgatttcattttatggtgaggcaattacagtccagagaaaagagtggttttgtcgataattacaggactgtcaaggctggactccacagacaggcttcctgagttcaacactgtctcattatcctctttgcactcccttccaggcagagccacatttccctttcagtttctctgttctagatgccaatcttccatatacct

SEQ ID NO: 403080 - DNA, 371 bp, Homo sapiens
ccaaggccaatcaccctgttgcttgtacttaggggttaacagactggccttccaaatcatgtcctttttataaataaagttttattggcccacagctaaacttatttccttccctattctctgtagctgcattacagtggccgagttggaacctctgtgctacaacagcagtggcaacagagctgataacaagtaggaccagcaaagctcaaaacatttactatctggcccttaactgaaaaagtttgcggatccctggggctcaggtgaagtcaaactgcaaacattctcagtttcctcttccagatccagagggctctgcaaatcaaggctggtgtaagaattgccattctggtctgtgccatgtcagc

SEQ ID NO: 403081 - DNA, 222 bp, Homo sapiens
gaggagtcagactttcctctgttgattaatagttctcaaattttagttattctcttactgtcttcgtgagctttcctatatctaagaacaacttatgctattatagtattttgaaaatgaattctaggttgactcactaattttactgaccatctaagtaataatatccatggtttgatacatatatattattattaaaatgcaaaaatataatgatatatt

SEQ ID NO: 403082 - DNA, 298 bp, Homo sapiens
atttccatatgttcattttattattaaaaacgaattactaaaaagtgatgacctgtttggaattcatatcttgctttaccagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttacctgggcgtcggctgagaccccaaaccctcttcctcctccatgaga

SEQ ID NO: 403083 - DNA, 410 bp, Homo sapiens
ctttttttccttgctagtttgagtagaaaaataacaatttttccacaagttgatatgtagattcagcagaatccctatcaaactcccagcaggctttagaagtgcaaaagactagccaggtgcactgtggctcatgcctgtaatcccagcactttgggaagccaaggcaggagaatcactcaagtccaggagttcaagaccagcctgggcaacatagtaagacccccaacctctaccaaaataaataaataaataaaactagccaggtgtgatgccacatgcctgaggtcccaggtatttgagaggctgagtaagagaattgcttaagcccagaagatggagtttgcagtgagccaagattgcaccactgcactccagcctgggcaacagagtgagaccctgtctcaaaa

SEQ ID NO: 403084 - DNA, 224 bp, Homo sapiens
catagggaagggaaaaagatacctcgcctccgccactccatcccctcagttggaatcagctcagaaccagggaggactcctttctgcagggaaaaataaagacgaccccagcaattctgattgccactgcagacacctgcagcctttgttatcagagactcctacagtcctcacaagctctaaactcaactgagagagctccctagagtcacatgctgagctat

SEQ ID NO: 403085 - DNA, 423 bp, Homo sapiens
ctctagcggatccccatgctatccctcctttgcattcacaactttctgtctcaaggggcctagctttcactctgtctcagctttcgatacatattcctcactaagcttaatcatttctagcttttaatttcaagcgggagacgtatgactcttcctttcacttgaacacttagaagtcactgcagggttattaataccctaatttcaatattgttgtatctcaggaaataagaaggcccaagaagagggagggagagagatggaagaactgccggttggtggagcagtcagaacatacatatttctcgatcaagttggccgtcttacatggtttgtggtgccccaaaacaattacaacagtaacatcaaagatcactgatcacagatcactataacacctataataatgaaaggtctgaaata

SEQ ID NO: 403086 - DNA, 1076 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtgggaaattttaaggtgggggcccctttatttatttaccatggttcttttcccaattataag

SEQ ID NO: 403087 - DNA, 4772 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctattttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagaccctgttgcttgccccaaaaagcttgtggggggtggtaagttctcacgagatttatttatctgagcaacattggggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgataaaaaaaaacaaaaaaaacacacaaaacacacaaaaaaaaaacaaaaacaaacaaac

SEQ ID NO: 403088 - DNA, 4663 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctattttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagaccctgttgcttgccccaaaaagcttgtggggggtggtaagttctcacgagatttatttatctgagcaacattggggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaacctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgata

SEQ ID NO: 403089 - DNA, 3363 bp, Homo sapiens
  misc_feature (3363)..(3363): n is a, c, g, or t
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacattttttaaaaaggttaggcttagtgcaaagtttaaaattatatgattcttaaaatactgaattagtttctaaactaaactagaggtataggtggacctgcttgaggtatctttgtttcatggaacatttttattacatgctttatatttttccttggtcacaccctggtactgaacttttttccaattacaatctgggtaagttatttgtgactttaagatgtttctaagtcatgggttattcaagtgaatgttctttttgggcattaagaggctagatggacgctagggaatgggccggatctatggtttcacgaagggcgagcacatggtgctaaatggcgtcggtaaaatccgtgaagaatgcttggtgtaaagggacgaaattgagcatcatgtgacacagatatatattgttcgtatcattatatatgcgn

SEQ ID NO: 403090 - DNA, 2746 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggtgacagagcgagactccgtctcaaaaaaaaaa

SEQ ID NO: 403091 - DNA, 435 bp, Homo sapiens
gtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtaagaacttttaaaagttaatctaagttacaatcagaggtatatatgtgggctagcactgttagattgaaatctaacttgactctcttatttggtgacatgttgaatatgcaaaatgaattggctgaatagttaatgtgaaagtctttaatttttacacgtttcattcctcagtgcttgcaatagggaagatgacaggtcatcttacttatatagtaattagaataattctgatacttctatgctagaatccctgcctttttacaagttatattcttcc

SEQ ID NO: 403092 - DNA, 4716 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctattttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagaccctgttgcttgccccaaaaagcttgtggggggtggtaagttctcacgagatttatttatctgagcaacattggggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgata

SEQ ID NO: 403093 - DNA, 4916 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctattttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgtaaaaaaaaaaaaaaaaaaaagaaaagaaaagaccctgttgcttgccccaaaaagcttgtggggggtggtaagttctcacgagatttatttatctgagcaacattggggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgataaaaatctactacttttctacccttctttattattttatcttctctttttatatttatctctttctacttatttcattttctattattattcaataatatttgtggcgcccctcttctactctcttttttatatttaatatttatttgtttgcccctaattagatctctttgttcatatcccctttttgggcgggtttcat

SEQ ID NO: 403094 - DNA, 4072 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtggcaaaattgatttaattgaagcaggggcttttacaaatcttgatgttgtttttatggcccacccatcacaagagaatgctgcttatctaccagatatggctgaacatgatgtgactgtgaaatactatggaaaagcatctcattctgcttcttatccctgggaaggattaaatgcattagatgctgctgtgctggcctataacaatctgtctgtgttcagacagcaaatgaaaccaacctggagagttcatggtataataaaaaatggtggtgtaaaacccaatatcattccctcttattctgaattaatctattacttccgtgcaccctcaatgaaagaacttcaagttttgaccaaaaaggcagaagattgcttcagagctgcagctttggcttcagggtgcacagtggaaattaaaggtggagcacatgattattacaatgttcttcccaataagagcctatggaaagcctatatggaaaatggaagaaagctaggaatagagttcatttcagaagatacaatgttgaatggcccttcaggatctacggattttggaaatgttagttttgtggttcctggaattcatccatattttcacattggatctaatgccttgaatcatactgaacagtacactgaagctgctgggtcacaggaagctcagttctacactctgcggacggccaaagctctggcaatgacggcactggatgttatttttaaaccagagttactggaaggaatcagagaggactttaaactgaaacttcaagaagaacagtttgtaaatgcagtagaataaaagacttaggggccacttataaatcaagaagacgtgatgatttttttcttttaatctcttttaatgaaggcatgcttgttttttaatcttaaaggagtaaaattctttttacctgataagtgaggacagggtgtggagaaaacatattaattacctcatatctaaagtgaaaatttttgcaaatccgtacttgataggattatgatattacaggagctggtatgtgatgccattctttctttttttttaccccgcaaccactcaccttcacagtagtgataccatttcttaacctggaggatacatggcatcatttttataaaatatgttagtaaacctttttgtaagccttaaatgttatgtgtatttttaaaagcttaagagatttcaaaccttatattcagaattgacacccatgagagtgttttgtggtatagggtggtaaacttgttctctaatcgtatattaattcctctaccagattgtatatttgaagccagtgtctttccttttttttttttaagatagagcctcgctctgttgcccaggctgaagtgtagtggcacaatctcggctcactgcaacctctgcctcccaggttcaagtgattctcctgcctcagcctaccaagtagctgggattacaggtgtgtggcaccatgcccagctaatttttgtatttttagtagagacggcatttcaccatgttggccaggctggtctcgaactcctgacctcaggtgatgcacctgcctcggcctcctaaagtgctgggattacaggcatgagccaccgcacccggcctgccagtgtctttttaatacacatgtgtgttggtatttttaaattgttacagtatctagcatattgcttactctgaatattcagtactttttgaataagcaaatattgcttccttgcttggaatcatcagagtttaaagtagcttcgtggatggaccatgatcctaagatgagttttaattttgtgtttacagtcatctcttgtacaacgtggagaagaaaagatatacttactactttgcttcaggtacacataagaaaacctcttttttaaaaaaatttttatttttttacataatagagacaggggctcgctgtagcttccaggctggcctcaaactcctgggctcaagcaatcctcctgtcttggcctcccaaagtgttgggatttcaggtatgagacaccacacctgcccatttttgtttggttttttaatgggcaggttcttgctctcccaggctggagtgcagtggtgtaatcacagctcactgcagtctcgaactcctggactcaagcagtcctcccacctcagcctcctaaagcactgggattacaggcttgaggcactgcacctggccctgaccattttttaaaaaggttaggcttagtgcaaagtttaaaattatatgattcttaaaatactgaattagtttctaaactaaactagaggtataggtggacctgcttgaggtatctttgtttttatggaacatttttattacatgcctttataatttttcattgttcacaccctgtactgaaacctttttctcaaataccaactcttggctatgttaaatttgtagactttaaaagatgttatctaaattaatggtttaaatatacaaattgaaaatattttctttttagtggcaattttaaaagcaggccttaatatgggacctgcttttaaagtaaaatatgtggtactatgaattactaaattgctatataccatgtaatagtgagtatagctaatatttagtatgccttttaaaaattttggactgcttttcggttttaacaaattctccacatgtgaactactcaagaaattttccctttttaattgcctctatagcactcataagagctagggcattaggataaactagaatattttatgtttatgaatacttgtataaacttaaaagtgttttgatttcccacaatttcccaaaggaatgtttatttattaagagttgtgttgataatttaactgttacaatttcagcagttgaattcagtgaacactggttgaggagtgcctattttctaagcactgggtgtaagaagaaaagacacttgcaaaggaagagctaagattaacataatttctttggtttttctattgcttgttattattatgtaaaaactgggtggcagttcacaaggaagattgttgtaacagaagagtgacaaccaatagttttttgatcattaaatcaaattttgtaaacagtggcaggagcgtggacttaaaacaaggcttgcttatttggttttgtcaaagttttacgaaaatatatgatatatatttatactaaaactatataatccttagatttaggaaagcaatcagttaatgtctttagcacactaaagcagtattaaacacaggtacaagttggaaattgtagaaaactgaaagaaaacaagacaaaatgtctatggtagggaataaaagagtttaagatattatgtaaaattatgtgtattttcttctcttttacataaattgtttgtgaaaagtgtgctcaacttttttacaagagtgatattaacttggatttatttttcaatataatttggagaccctttgttatccaaataaaattgatgagtttctgtgcctgt

SEQ ID NO: 403095 - DNA, 1180 bp, Homo sapiens
cggggtcctggaggcctctgggcgcgtgcgcgggcggtcgctacctgcggccgagccagggagcgagagggcgcagagggcagcgggcttgggcagcatgaggcccggaggggagcggcccgtggaagggggcgcgtgcaatggccgctccgagctggagctactgaagctgcgctcggcggagtgcatcgacgaggcggccgagcggctgggggccctgagccgcgcgatctggagccagcccgagctggcctacgaggagcaccatgcccaccgcgtgctgacgcacttcttcgagcgggagccgcccgcggcctcctgggcagtgcagccgcactaccagctgcccacggccttccgcgccgagtgggagccgccggaggcccgggcaccgagcgccacgccacgcccgctgcacctgggcttcctctgcgagtacgacggctgctgcccggcatcggccacgcctgcggccacaacctcatcgctgaggtcgtgggctggcggccgcgctgggcgtgaggggggccttagagggcctccccaggccgcctccgcccgtgaaggtagttgtcctgggaacccctgcagaagaagatggtggtaagttctcacgagatttatttatctgagcaacattggggactgagggaacatctgaaagctaccatcttgaaaatttttgaggaagtgtttctgaaatatttaaaaatacttaagtcagtcattttgaacaaaagaaattgatacaataagtttttttttttaaggatgattgtctaattttgtaatatgttgttttttaaaaacctgtctgatggtgttttatacatttctaactttttacctgagttatctctttagtcttttggaaaataccctacacaatactaacctttaaaactatcaaatttttgttataagataaatgttatctttgtactagatagcaaccctttataaggttgtaaggtataataaactgcttatttttttacatacttcatatcaagcattttgcagtccaattatatagttgaggatggtgtattttgatatgtatgaagttaatattttcaagtaagcaatcagtctactaccatcagattataagcttttttgtaataataggtacataaaatgtgtatgaaaaatctacaataaacatgtttatctgata

SEQ ID NO: 403096 - DNA, 401 bp, Homo sapiens
aaacaaaaaaagctaagagagacacattatatccaatgtatgttataatacttatttaaagggtatcataatattttgagtttggggaaagttcaatcctaatgttaatgtttatgaggaaatgtgtaatattcatgcatttctatgcaattctctacttgccacaagccaaagaagaaacaatcaatttacaaataacacagaggcagtaaatttgttggtggtgatgctagctaggcctattgtaattccataattctgtagttttttttcaacctgcaagtggtgaattgctaatgttgctgggagccaaagatatggtgatatgtgaaagtgtccaggcagcgcttacattatgtaaggcttggaggtattttgatgtcagtaaaatactttatggg

SEQ ID NO: 403097 - DNA, 454 bp, Homo sapiens
ccgagatgaaaccatctaggcagtgagggcagcgcgttagcagagaggtgaaggatgaagagagagcaccacatgcacatccgagatgtaaccatctaggcagtgagggcagcatgttagcagagaggtgaaggatgaagagagagcaccacatggacatccgagatgtaaccatctaggcagtgagggcagcatgttagcagagaggtgaaggatgaagagagagcaccacatggacatccgagatgaaaccatctaggcagtgagggcagcatgttagcagagaggcgaaggatgaagacagaacaccacatgcacatccgagatgaaaccatctaggcagtgagggcagcatgtcctcactgcacagtcgagtaagcacagtcgagtaagactgctgccaatttctttctttttttttttttttacagatacaatcttctctgacattgat

SEQ ID NO: 403098 - DNA, 627 bp, Homo sapiens
tgtaaagcacttaaaacaacgcctggtacttggtaggtgctattctacatagctattacttccaggtgtaacttatggatatggataatatgaaggagcaaatgctgatagcagagactgttccagcgagatataaaaggtcaattcgatttagttggtattagaagaccgctgtctctttgaagcatggaatgagccacaaaaaagagccaaccaggggtttggccaacgaaactcatctactttccagatcctcatcaagtgttttcaattttcctgcttaaactaaatttccagagcaccacatcaaaacatattcaaaatttaaatataaatgatttggagactgtctaattttacattttccacaccttatttccccttcactagtttgagtaatgaaaaatcgattaaaattgaaagccttagttggaaggcacaaaaagaataagcaataaagagagaataaaaactaaatcatcatataactcaacagagaaatgtagaattgaaccctgaaatacgtgaaaaaccgggacgttgtctgagggttaaaagtcactacaattagtacaatacactatttatttatttttcacaggtacttgatgagaaggaaaacaaaaa

SEQ ID NO: 403099 - DNA, 440 bp, Homo sapiens
ggctttctcacaggcagaccagggcagcctctggtccctgcacaatctcgcctccgatgcaaggtgggagaaggcagccacctcccgaggggggccacagagggggttctgatccagctgtgagctctcacccccagcccacagcgactggtagccaggtaggcagaatggcaggcagagcggccactggggaactgatccagcaggacctgaagcagggagacagcacacgggcgtccacctaacgtggccagcccttgtgtggacaaacagctgagaaaaggcattactaacatggacgtgaagaaagtcgcctcggtttttgggtgtgatgtggtgttggtgtcgtgttgttgcgaaggccctgtctgaaagtcgcctcggttttctggtgtgatgtggtgttggtgcgtgttgttgcgaaggccctgtgtgaaagt

SEQ ID NO: 403100 - DNA, 617 bp, Homo sapiens
cagatcatcaggcattagattctcataaggagtgtgcagactcaatccctcgcatacacagttcacagtagggtttgtgctccaatgagaatctaatgctgctgctgatctgacagtaggcagagctcaggcagtaatgcttgcttgtccactgttcatctcctcccgtacagctaagttcctaacaggtaccagtgtctgaagcctggggactggcggctgctggtcaaggccacattagtttattgttaagtgcaaggtttctggtaacagaaataaagaattcaattgattcatcatcaagaccaaatatatttactaaagatctaccttaaattcattttttagcaggtagtatggcattgtggttaagaatttacatttgtgaacatttaccagctgatgaccgaggtgagcttctgtttcctcctgcataaacttgagattataaaaatcccctagttggctgggcacagtggctcacacctgtaatcccagcactttgggaggccgaggcaggcatcacgaggtcaggagatcaagaccatcctggccaacagggtgaaaccccgtctctactaaagatacaaaaattagctgggcgtggtgttgcacac

SEQ ID NO: 403101 - DNA, 154 bp, Homo sapiens
atccatttgccaaaaaatctactcaacttggagaatggccagcatgataaattgccaattgtagtattacttagtcaccaaacattgtttctgtttaccagtataaaatctgtagcaatttatgttgaatgagacagttcaccagccactgaag

SEQ ID NO: 403102 - DNA, 684 bp, Homo sapiens
cagatgtaattggtgccctctgtaattccatgcatgccagcccaacttttaactgtccaagatttcagggagccctctgccattggatgtggtggtctgaaaatgctagagaattaatgtccctttaatatttaaagttatcagctttaaatactccagcacactttccccctagaaagagcaaattctgattcatgtaatctacattggttcccagaattatccagacaattaagatctactcagagtggtaacttgtttgataatgcatgatttatcagttctcttctttatttctctaagtctttcctaggatcactttccaaataaaactttggtatttgaaaaattaggaaagagaagttggttgttagaaattagaaataaaaattccactttaaaaaagaactaaataatgaatgaagttggacatgcatggacctctgcatctaagactatgatgataatatgtcatgaatcaaggatcatgaataatccaattatatgaacctatggtccaaaataaaaggctcagaatatccagctccatttcttcccattctttgcttacccagaaatctgctagttatagttgagttctttgggtggacaaaaccccttagaaaattacaacttcaccatccaaggccaagcacagtgactcacacctgtaatcccactact

SEQ ID NO: 403103 - DNA, 306 bp, Homo sapiens
gtaagggcctaaggagtagcctggagctatgtgttttttgttgggaagtatatttttaaatacaatattcaaaattttactttcaggtttatgccatggggattttaagaattctttccccaccattgttattacaacacaacctcctacattaactgctcttaaatttacagttttagccaatatgacttattttacagacagaatatttgcttatactgtgaatgggggatctcgagatcccccatacagagtacgtgcaataccattcaggacataggcatgggcaaggacttcatgtctaaa

SEQ ID NO: 403104 - DNA, 652 bp, Homo sapiens
ctcagcctgcccagcttaataaactaagattctagctaccatgtcacttgtgcagatggcacgggctcccagggttgtctctagaatgatgacaccccttcaccaagcactgtggaccttctttagaattaaagagggggctggacacagtgactgacgcctgtaataccagcactttgggaggaggaagtggaaggattgcttgaggccaggagtttgagaccagcctgggcaaaatactgcctttgcaaaattatgactgagacagtggaaagagatctaacctgactccatcttgcttctaacctccaagctatccttgttcattcctgggtggaggctgaactaacttcgggagaaacttatagtttatagtttaaaacaaagatgataacagccctttcccaaaacaaacctccttgcctggggactaggctgcctttgtaggactaagaaattagccacaagattagaaattatggtttaggattcatgcagctggaggttacaaaatcttgaccctccctaaactgctcttcagatcagtgtttgagatattttgcagaccctgcacttgatggatcagctgggaccacccagatcgataaactggctcatctgatcttgtgacccccccccccccacacctaag

SEQ ID NO: 403105 - DNA, 227 bp, Homo sapiens
taattagaggttagcaggtgtttattattaacaatagtttcagtattcatttttattaagttctgtgcacattaatcccttccagccagcaggcctctagttagtctaggcctctgatttcagcttgaatatacactttgctcttttggagaaacagagacctctgcctaagtgaaacaggacatgtaaagggaggaggaataccaggctgagatttcatacctttg

SEQ ID NO: 403106 - DNA, 151 bp, Homo sapiens
ccatttccactgtcctctcttctttcacagccattttcttcctctttctttgctcattgttttttcattattaggacttggctttttaggtcaagactcctaataaaaggactcctttcttctgctgttgccttaccagtcacatatgtgg

SEQ ID NO: 403107 - DNA, 676 bp, Homo sapiens
gatctgaggccagatggggccaagcctagaaagctgggtctttgccaggtgttgagcagcgtgacccagacacagtctgagggagctgctttctccacccagcacaagctggatgagcgtgcaccaggatgcccatcccagctccccaggccagagctactgccatgactgctgaccgggggctgatctctcacttgccaaggcatcaacaaccactgtgacccaaatatcagccaggggtagagtccagtgggaaaagtttgaaggatttcctcaggtgtaaggaatttgcattctaaatgagtaaccaacacccaagaatgagtacctagcaacaggctgtatttgaaggaagtgatgtggaaattaggactctgatggaacttgagaaatgggcaagatgacttctggctgggccagcttatctgaccaccaaaaacaggccatttaggtaatgcatcataaactcaaatatacaagaattgggtttgttatgaaattgggtaaaacaagtgagacaggctcatgtcacccagggggatggcagggacaacctttgacttgggggcttcccggtcctatttcccagaagctgcctgcagacccttgcaacacagcaaggccacagtaatgtttactgtttctcttctgagctcaactgttatcatccaaggga

SEQ ID NO: 403108 - DNA, 640 bp, Homo sapiens
tctgctaagaatacaaaaaaaaaaagagctgggcgtggtggcaggcgcctatagtcccagccacttgggaggctgaggcaggagaatggtgtgaaaccgggaggcagagcttgcagtgagccgagattgtgccactgcactctagcctgggtgacagagcaagactccgtctcaaaacaaacaaacaaacaaaaaaaccccacaaaaccttgtgggtgtctgagacaagaacatttcaggcaggaataacagtaagtccgaaggccccaaggtaggaactgcatgcatgatgccgtggagaacagtcaagaggtcattatagctggagtaaagtgagtgaaagagaatggtaagaaataaggttggagagaccgggtgcggtgggctcatgcctgtaatcccagcactttgggaggccgagatggatggatcacctgaggtcaggagttcaagaccagcctggccaacatggtgaaaccctgtctctgcaaaaaatacaaaaattagccaggtgtggtggcaggtgcctgtaatcccagctacttgggaagctgaggcaggagaaccacttgaacccaggaggcagagattgcagtgagccgctccagcctgggtgagagagtgagactccatctcaaaa

SEQ ID NO: 403109 - DNA, 499 bp, Homo sapiens
aagttgggggccttctgtatgggtaatggtcagcccacaagaaagaagccagtaactttccctgaacacatccttttggaaaataggaacaaagattcatgctcaaaactcacctccttctggtagccttttctgactaaccccaagccagtgacaccaaaacagacacatggtgattcatagccagggctttaggcatcagataaagtgagattcaaatcttaattctattatcagcagtgtattctcaggataagtcacttaaacctttctaagcctgtattctcatttatgaaatcaaaatatcatctcttggggttgatttgaagagtaaatgagattatgtataccaattagtaaactcagtgagtgctaaggcacatggtaaatgctcaataaatggtactcctttttatttgtgaatgaaccaaccgcctcctctagctactatttcaaaaatttcttccatactgttgtttctgagtcaaatacttttcca

SEQ ID NO: 403110 - DNA, 792 bp, Homo sapiens
tcaaagaagcatcatcaaggtgaggctgcatcataaagtctcagccagcatcccataccttccttaatggggacgctgaacagaggttacatgagacatccacaattaaggtgggatagccccctcacagcaggtggggcccaaccccctgccctggcctctgggttgaggttgttgagacccagcctagagactccatctcttctagcaaagggcaggaagcagaggtccctcacccctgggctctaggacagtcatgtccctgtgtgagcttcccacactgcctacagttgctgccagcagcaatgaaatggattcttgaaaaaaaaatctcagcatataagatttgagaaaagaaaaataccctacacatcagggacccttgaaattatagcaataaatttatgattcattccctaggcataaaactactgtgttacagccactaccaatgccactgaatttcccagggtctaatgttgacctcaggctcgccagcaaaggaggaagaacataagagacctcaatatttagagggttttacatttcctatacaaaaaaagagcaaacgaagagtgaagagctagctgctacagtaaaagaggtaggattattggtcaatgtgtagcaaatcaaatgttaggtaatataggaattgtgggaaccttcctggtatcacatattcttaaatgcagcaagatcatagagaaaaagcatggatatcactcctggccttaaaatttaagtgggctccctttgtgtacaacaaaatcctaactccttcacaaacat

SEQ ID NO: 403111 - DNA, 240 bp, Homo sapiens
agttcatctgaggaggtggaaccttgctcaagcctaccaaggagaatgctgggcctgaaaaagtcaaatggtgtctccatagtaaccagtagggcctgaggtgtcaaagcaatgctgcggtataatagaaaaccccaggcctcttaactaactattggagtgggaggagatggcattgaataatacctgacttgcaaacctttcaaaggtggatgggtactcagattcatgattaaaatg

SEQ ID NO: 403112 - DNA, 442 bp, Homo sapiens
gccctgccaccagactcagccatttctatggacacatggcaggactggagtgacacgttctgatgtactttaaaagactgctctgtctgcttctggaaattggatcggaggggaacaaagtggaaccagagagactcgatcagaagctaataggaaagtaacaatggcaacctgagattcggggcaagggggtactgaattggagaatcaagcaagaccttcagagagctcagaagtgggctgaagatgagaaacggctcctaggtttctggtctaaacaaacaaatggaaggcataggccttcattcagatggggaagggatagtgatgctgagaaaacaccaatgaataccaatgatgaagtaacataactagttttaagctatactcagaaaacacaactaaactgagagatgatggcttttttttttttttttttttt

SEQ ID NO: 403113 - DNA, 225 bp, Homo sapiens
atttaactataccaatgagtaacataagatctggccttgttaatgccagaaagcctggttagacatacactctgtgtgtggtttttggggggatttgggaagggatagtgatgctgagaaaacaccaatgaataccaatgatgaagtaacataactagttttaagctatactcagaaaacacaactaaactgagagatgatggcttttttttttttttttttttt

SEQ ID NO: 403114 - DNA, 682 bp, Homo sapiens
gattgttcctgcccaacactgcctccctcgcctgtgggaacacctactagcttatttgggctgctcatcacacgagtgcttagcactgttggcatataattatatattatcttcttctggattgtagaattctgagagggaagaaagcaggtctaactgccttctgccacaagttgttccaaggctccccaccttgtccctgtgccctctactaagactgcatttgaagttacttcttcactggggctggtggggtctggcttctcagatactattcaccctacaggatctaccggctgccgtatcctacttcccctttctgtgtcacctgaacacttcaaaacctagactgtacatactgctacgaatagctgatttttaaatactttatacataatacataaattcatagtatttatgaatagtaatgtttgagcaccatgttaaacctaacatcatgttaacatagtaggcactatttatggcctggcacagagtaagcatttcataatgttagcagcaaactgctgggctctgtgttgagcattttgaattctttaattcattttatcctgtttacctgatgaggaatgagaaattagagtccccaagacaaaatctagttaagattgtatggtaagtggcagaactgatcggaaccttctagagtccctgttcttag

SEQ ID NO: 403115 - DNA, 368 bp, Homo sapiens
gaatcacttgaaccctggaggcagcggttgcagtgagccgagatcgcgccatgcactccagcctgtcaacaaagcgagactccgtctaaaaaaaaaaaaggaagaaataaaatcattgaggagaaaggctatctgcctgaatagtttctgttttttgtttttttaaattaaaagatagagttttgttctcccaggccggagtgaagtggcatgatgactcactccagccctgacctactaagctcacatgatcctcccatctcagtcccccgagtagctgagactgcaggtacacgccaccacgcccagctaatttttaaatcattttgtggagactcagtctccctgtgttgcccaggctcgtcttc

SEQ ID NO: 403116 - DNA, 344 bp, Homo sapiens
cctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcct

SEQ ID NO: 403117 - DNA, 454 bp, Homo sapiens
acatacttggctctaacaaatagtacagtcagttcatgaatcagtcttcatttattttcttcctggacacacattaagttgatgttctaggatgcaaatagataaatgacttctagtgtcatttctgaaatccagtcattatgactgcattcctactatagtctgaacacctcaaaatatttcagcaaatggccatgtcaatttcaacttctccatttctgacccaaacacagtcaaagcaggcagcattagtttctttttgacttaatgtgtatccccaaacactcaattttttacactccagtgttggctttataagacatataaacaatcccatacttgtcgtattttttcttacaccagacaaaaacagatcggtgataaagcacactgatgtttttacatttcacctaacataccaaaccgattttaatgcacatttcatgaatctcag

SEQ ID NO: 403118 - DNA, 229 bp, Homo sapiens
gttttatcctcaggactagactaagaaccaaatcaaacttaagttagaaagtggccttttacattatatgaacgacaagggtagagtttgcttttctcctaaattctcttttcttatgttttaggcccagcagaaaaggaaacaggtaattaatatttctgcatgcacaagccattatttctcatgtggtggtgtgatatttttaaagcactttgttgagacatgattg

SEQ ID NO: 403119 - DNA, 481 bp, Homo sapiens
ttaaaaaaatcactggcattcaaaaagggtacattggaggaggtaagagacttttctctagattagtagggatttgaaggatctgacaataagcacaatgtatgggcgttttttgtattttgattcaaataaagtagccgtaagaaataaactttgattcaaatggggaaatttgaatatggactatatattatactgatattgaggaattgttaattttgttacaatttacgttgttaaacatgctcttttttggagatgcatcaggaagcatgtataagggtataatgacatgatatctggaattttaaatgatggcaaaacgtataatgtacatagaaataaaatatatacacattttttatggaggaaaatatatatatatatagatatatatttgctgtttataaaagcacctctttgactcaacagctagcatatgggttacactgggataagtgttaacacagttagcccgcca

SEQ ID NO: 403120 - DNA, 151 bp, Homo sapiens
ctctgccctggcctcccagcctgggatggtcaccattctggatgctctcagttgaccacttggccaaggggaagagactcaaatcacagttgatgaggtctagaaactaccccaacactccatccccatccagctgagcccagagcaaaga

SEQ ID NO: 403121 - DNA, 203 bp, Homo sapiens
accagcctggccaacatggcgaaacatatgaaaattacaacaaagcaaccaaccaaccaacccagcaacaacaaaacaggtctaccctggagttatactctaagtttttctattttcctccctttctgatcctttatcccactttctttttcttcctcttccttctccttcttgtcaaagacatagaggattgagttattatc

SEQ ID NO: 403122 - DNA, 376 bp, Homo sapiens
ctggaatccaaaaaggcttacattgttgtgagacagagatgccacttagacttaaccattcatagtatggaccatttcaagaggggtcaccatactttgcttcaattccatgttaactaaacaatctttttcttgctaatctgaacaccctgtgcaatagagtctgactccattttttgacgtttgactgcagacatcttttcagcctaacccttccatcttctctttctgtccaacactggggcaagctgacaaaaatcctcaggtgctcctcttctgtaaccagcagtaagttcgaatcatacactgccaccctcaccccaaccctgtcccttaaccacattaaaacccaaagccagtctcctttaattttatc

SEQ ID NO: 403123 - DNA, 509 bp, Homo sapiens
ttacagaggcttagggttttggtgatgggtcaaggctttgtacttaaagagactggattcaaatacaccctgctaaggaaggggtggcctcagatgcagtgtagtcaggctcactcactttcccaatgaaaaaatagatgctgagaaaggaggtccttgccatcaaacaggaactacatgttgtccaactatgccagggaaactgaggaatattggcttccactctgcattctttctttcttacatatatttgtgtctacaatgccttaagagaagtctctttgttcttttattactttaagagttccagatacctactgcagcctcttgggaattgatcatttttaggtttgatcactaaagaattttttatctaaatttggggagtattggttttttttttttccaaaatatatatgacccacgtgtttgctttaaacaattttaactataagaaatagaatcactgttatttgtggtttcccctttaaggggatggcttctttaaa

SEQ ID NO: 403124 - DNA, 1012 bp, Homo sapiens
  misc_feature (862)..(862): n is a, c, g, or t
  misc_feature (867)..(867): n is a, c, g, or t
agcgggtgtttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagcctgctgggcactcctgtaggaggcctgctgatggcatttcagaagtactctggtgagactgttcaggaaagaacgagggtgaagggnctgantaatgggggtggagggttagtatgaggtccggaatggaggagtagaggacggaattgaaaaggggctacaggtaaaagaggaggggtaagcggaggggggaagatcgcagaggggtggtaaaggatctattttataattatcggg

SEQ ID NO: 403125 - DNA, 1289 bp, Homo sapiens
  misc_feature (925)..(925): n is a, c, g, or t
  misc_feature (977)..(977): n is a, c, g, or t
  misc_feature (980)..(980): n is a, c, g, or t
  misc_feature (982)..(982): n is a, c, g, or t
agcgggtgtttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagcctgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctncctgagaaaattgaaagtagtttacaggaagatgaacctgaaaatgatgctnagnanattgagcccggtaagcttcctgaaaccttcgtatggataccagaccagggctgaatgtcgacttgaacctgggactaaggactgccagttcgatagaatcgcaaaaaggcccctgggtccgcggcgcaatatagcgggccgtggtgagaaggatcgaatagcttctacacaaggggcggacaccaaacatcaaaaccatgtgagaccaaaatgaattacccacgtgagatacgaaaaaacagcatcgcactcctctgaagtcttctctgcttatgttgtcctccctccctctcggggagagagagag

SEQ ID NO: 403126 - DNA, 539 bp, Homo sapiens
cacgaggcttgctgaaggttagccttctctctctatctccatataagttctagtatatctaccagaactttgcctaagtaagttttttttaacatttgggagttgatatttgaacataatattatgaaaacagaaatagagtggcctacaggtaatatttgttagggattaagaaggctcatgtgaaaaataacctccaagaagtatcaaataacagctatctagccaattatatgcactcagagtagcaaggcaagggacattttaattctgtcatctagaaacaaacctgtttaaatatgtgttttaaaaaagaagtctataagaataatttttaagcttatatgtatacactccatgtttattttattgtgttgtactttatattgaggaatgacctgcaagatgaaagggaccattgtgaatttggagacctctcatttgctaaatgtaagtttttctaccttaggacataaaaagcagcaatacgaaaagaaaatttaattacaagagggagaaaagaaaatgtgggactgaga

SEQ ID NO: 403127 - DNA, 513 bp, Homo sapiens
cttaagcatgtggtttgggcgtcctaacatccttgcctattttctatctactcaaccaagctgtgtgtgtgtttctccttgtatcttttagaatttttactttgtggccaggtgtggtggctcatgcctgtaatcccagcactttgggaggccgtgacagacggatcacctgagttcaagacccatctctactaaaaatacaaaaattagccaagcgtggtggcaggcgcctgtaatcccagctactgaggaagctgaggcaggagaatggcttgaacccgggagtcagaagttgcagtgagccaagatcatgccactgcactccagcctgggtgacagagcgacactcttcctcaaaaaaaaaaaaaaaaaaaagaaaagacatatacaggattctagttagcgggtatgtgaactgaggttcttgcctggagctgattctgccatcggttgatgtttggcaactgctggagacatttttggttatcatagctggggagggagagatgctac

SEQ ID NO: 403128 - DNA, 411 bp, Homo sapiens
tcagaaattctttactaataaggtaaccagactgaaaaattcaaagactttttttttttaaaatagagatgaggtctccccatgttacccagactggtctcgaatgcttgggatcaagcaatccacctgccctggactcccaaactgctgagattacaggcgtgagccacagtgcccggccaagaaacatcatttcgtaatgtaagaaccaaacttgcctagttggatcttacatttaggcatcctgcttggtaggtagttttctcttacagggttattaggttttataagatttcatctaggctgtctttatggaattcaatgataaaatattttgtaatcttttcaaataaaaattatcaactaaatttaaagttttggtaaattttaaaaagtgtggcttgataaatc

SEQ ID NO: 403129 - DNA, 308 bp, Homo sapiens
caaacagcgaacgtgaaacatgacctagacgatgtccatttagacacggatgattgaagggttactatactgtggtgaccgctggcattgcttgctacccgtctccaactctctgactacggcacacagcaggatggtccctctagcattgggtgggactgagcaactggctctgaccattggattgtgagcagaggcaatgtgtgttgcttccaggctagagcttttaataatgccatgcaaagatcctccagagcattcatccctctgccaaggtgaccagcaatgttccagatggcagtcacact

SEQ ID NO: 403130 - DNA, 375 bp, Homo sapiens
atagtcataggtaaggaaggccactgatgtgaaaaatggtgattaaagcaaaagagagtaaaagagatttggaggagaagacaatgcaaaaaatgtggcccttaaaatttttggaaaagttagtcattgcatttatgaaataagaacaagaatgttcacagagctcttagaaactaaaacaaatccaatagagttggaggaggttgatcagaaaggagtgcagaaacaacaaaaaacaaacctaaatgatggtaaataggaagagatgataaaattagagggattatttaaataatacatgtttcaggaggagagaacaaattggaggagaaaaaatcaccaataaaataattcactaacatttctcagaactgt

SEQ ID NO: 403131 - DNA, 460 bp, Homo sapiens
aaactcagcaacaatgggctccaatgggctcactcccattagcattctcccttttctagatgcctgcattcccaccaggtgcttgatgcaacctgtcctgtaaacacaaatgcagtcgcactccctgtctgtttggaagcctcgtaacaaacccaagtgttcagttcttcccctcaatgactcaaacatttttcaacaaaagtaataaaccagtttgagccagaagaaatatatttttaaagctattgaaccagaattcaaaatacctttaaaactgaacctgaacccagccaaagttttattctgtttgggactctgattcagaattttgagagaggaccttaagtcaacaactccagcagagcaatctagaagcctctttgtctgattctctcctctggtccccagacaagagctcatttccctttaggttatgactgagatacactggagggtcata

SEQ ID NO: 403132 - DNA, 372 bp, Homo sapiens
gaaatagagaatgtaactatcaaatgaaaattaaaatgtacaaaacaagcttctattggcctcaaagtaaaagcccacatatttcctatcaactgaatttcatgaagatactcaactagttagtcttagtttcctatgaatcttgacaagctgtacagcttttacgtgctacagaaaattaatgactacaaaataacagaattgacttttttatgatgaatatacagctccaaaagtgaaaatgtaataactttaatcatttatactcatcaaataaaaacaaagtaaaacactaagttacagcatttatatcgagaagctcaagatgcttaaacacacacacacacacacacacacacacacacaactaaa

SEQ ID NO: 403133 - DNA, 345 bp, Homo sapiens
taaccgaagaagtcaacaaaatgtgaacatgtgtgatttaactattaaaacaaatggctgaacccttatttagatatagttgttagcatatagttaatgtaaattaaattattctttttttcctttttgagacagggtctcactctgttgcccagacggagtgcagtggtgcgatctcagctcaccacaacctccacttcccaggctcaagcaattctcctgcctcagcctcctgagtagctgggattacaggcgcatgccaccacgcccggctaatttttgtatatttagtagagacggggtttcaccatgttggccaggctggtctcgaactcctgacctcaa

SEQ ID NO: 403134 - DNA, 314 bp, Homo sapiens
gaagaaaatcctgtagttggtaaagggagaagtattttcgtagccctttcagctgattgtggatattctttgatactataccaaaattcagccagtgaaggtttcttaaaggttagttgcgacattgaaccagaatctatagcactgggtttttcatagtctgtgacattagaatccattgatccatcttgtacttggaatggatcttttgtgcttgcatgattttttttcaattgacacttaagttctgcagattttccatatgttgacatatttcactatacagtgtcaaaaaaaaaatcaacatttgttaa

SEQ ID NO: 403135 - DNA, 332 bp, Homo sapiens
ggccaaggtgggtgggaagaaacctccttgatttcaccaggtcctggatgagaagtcagtgttcttcggtgtaaagtgaagagcccgagggctggatgcgtggttgctgtgtcggctgtgtgcttgcacctcatacatgggacagcaggcccaagccttcggcgctcccctcttctgccatcatggcaaagccaaacccttgcacaggggacaggggctgcaggatgccttggtatcaggttcccaggaacgtgtctgtctccatggcagagaggccctcaggaaagccgacaggaccctaacaggtgacagtcctgggctgaggggttcaa

SEQ ID NO: 403136 - DNA, 698 bp, Homo sapiens
aaaactgggtcaaaaactagaaggaacgagggaggagtgataggaactgccaatgagaagctgatttcttaaaatgacttaagtatggttactcaattatatgggaatttaaaaaaattcccaaactaggaatagtaacaatctttatttccatatactagtcaacgatacagctaagttagtgggttacagagggcaatctagcaactgtgtctaagtgtggaagccaaagaaatcttgtgcagaaacctgttctttttaagtgccaccttcttgttcaagctacttcagcccgaggaactgttgcaaaagcatacaattaaaaggatataacactgctcaggaaaaagtgtttcaaaaggcttagcttcactaagcttaattcttcattaagaacgaaccaaattcgtatctctacctaataacgcaatcccaataatttgagatctgtgcttttctgtggtcaggccaagctgctctactggcccctgaaatgaactacccaacgaatctgaccaaaattcctgccatgagctactatgtttctgcaaagtaattattcaaaagcactgctgcttctggtcgatcttttttctttattatagaagagtccgttttcttcccccacgttccttgctcacaccccaaactaaacaggcatagtcttctccacctagacttgaggtctctgatcaaag

SEQ ID NO: 403137 - DNA, 2266 bp, Homo sapiens
gcgatggcgatgatgcctctagtcctgcatcatccagagcggcaggcggagctggggtccggactgcgagatggaggaggggcggcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgctctttgcctcagtcttttgtaccgagcctttaaatagatgccaggaatgaagctactgtgttaaagtagaaagtcaaccgattatcatgatttgagtcagtgttatgtgacttcaaaataaggtattgactggattttttttaaagaatgtgaaaatatgatttttgctgaggtgttatttttattaattgaattgtaaattttgattt

SEQ ID NO: 403138 - DNA, 640 bp, Homo sapiens
tctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgct

SEQ ID NO: 403139 - DNA, 319 bp, Homo sapiens
acgaaaagcacagaagcagaaacatagcatatggtgagtagaccagtttgattatgcacactaagagtgtaattaagaatgggagttataataaagtctgaaacttctgtcatttattttcagaggagcaggctactggttggcaaattcagatccatcaggaaaactcgtaataatgcatatgttcatcacttcctgaaaacgctgcacgtacaaaaagtcataattcttgggctaaaaatttagaattctgagcatttatcatgtgggtcaggaaaactggcccctgttcctctgcctcccttcacctggcatcacc

SEQ ID NO: 403140 - DNA, 668 bp, Homo sapiens
tgctgttgctgtgtctggggttgaccctcgtctgtgcccaggaggaagaaaacaatgatgctgtgacaagcaacttcgatctgtcaaaggtagagttatggaacgcattgacttctggctctggggagtggtttcagggattctgaagccatgtggatcctattgtagggcaggagttccttaacatatcagacaaaagcattggtttctgatcttgggttaagagcaattgtaccatatgaaaagatgacaatgcttggggatctccatcctccctaaaggggcagtggaaagagccctaggtgtggtgccaactgatctgagttctatcttcacttcaccattatgagccctggcccacaggccagagttcaaggaaagaagtgtccatgtggtatccccactcctcttttcttacccaatgaccttatttattgcagatttcaggagagtggtattcggttctcttggcctctgactgcagggaaaagatagaagaagatggaagcatgagggtttttgtcaaacacattgattacctggggaattcttctctgacttttaaattgcatgaaatataagtatggccttttttagttggggaaggaaaaacagaagcctgggtatggtcttgaacacacacacattcactgatccaggacttgatg

SEQ ID NO: 403141 - DNA, 964 bp, Homo sapiens
tgagacctgaggtgaagataaaggatgggtgggtatttcttcagaattcagcagaaagatttgccaacctttaagtagacacgccgttccaaatttgtaataatgtaaatgctttctaccaaattgtgtaatgaatatatttgaaatggtgattgatattattaatagatatgtttgacttattagaatatcatttaccaacatttagcaaaatcgagatagaatagcaagggtcattgatgagtaagttccatgcagatatgtaccttcctgtaacatttaccagatggagacttttgggtgtgtgccaaaagtgatgaattaaccgtgaaagaatgtgagacaaatgaagtgtgaaggtagttcaaaggtccttaaagagacagaacagcccactcttgccttcataagatttgctagagaaagaagtaggtgcctagtaaagtatttagggaaatctcagtctggctagtccttacaagaaagaaatcctttgaaaggaatacaatattcataatgtgactgttttaaaataaatttttatatgtttaatatttgtaaaaagtcctcattgagattttcctctcttcatcttattttgccatttctgtggtataaaataggtttttaggaaatttgactttgatttactcgtggaccattgcttaggaatgattaggttgcaaattggggattgtctgtaagacaatggctttttatttgggtgaggactgaagaacacatctcatgataggattattgaataaaatctgttgtttctgtgaatgctgaaaatggcagttggaaaacatatttattgcatttcatcaatgggcctctgtgcattggctattttgaaattgaatttacacatttcaaatggtcatataagcagtcattttgtggaatgaagcataattcaagactgggagttgggctatactgcaagttatgaataagatac

SEQ ID NO: 403142 - DNA, 412 bp, Homo sapiens
ggatatgtttgtttcttcaccacgcttcagtgctttttggaaaaagtggaaaacagcggggcggctggaagacaaacattttatgtgaacgtttggttttcttgataatcagagcaacctccgtgtgccttacttgaagtaactctagcgagttttgctatgtccctaggacggcatagcgtacacaacgcatcatgaagtatggatgcgattctggcaccaactgttccgttcctgctttcaccagaagctttgcgtctttaagcttcctttcattagaatttggatccaagtttgtggggaagactgtgaattcaatggaaagtgtcctttttttttttttttttaatttaagaactacttcaccttaaatcccacttctctaataaaataacttttactgtaaatttcc

SEQ ID NO: 403143 - DNA, 718 bp, Homo sapiens
agcggagggtggaggcgggaccagccgccgccgtctccgtctcggtgtcccggcccctacagcgcccggcagccgcggcgggaggagcggaaactgtcgggtgcgtcccgttcggagccgcgccggccgagaaggcgccgaagaagcagcgaggcggcctctgtccggcccggacccgccgagcggcgtgcgcgccccctccccgtagcctcgcggcgcggcctcgccccggcccctcccgagctcatcgcgggcccacggagcggccccggaggcccgagcgcgcccacctgagcccccgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgttgaacatctatggaagagacacaattgagcagtataaaggccgtgagctgtatgagagaccgcctcacctttttgctattgcggatgctgcttacaaggctatgaagaggcgatcaaaagacacttgtattgtgatatcaggggaaagtggagctggtaaaacggaagccagtaagtacattatgcagtatattgcggccatcaccaaccccagtcagagagcagaggttgaaaggtaagagca

SEQ ID NO: 403144 - DNA, 425 bp, Homo sapiens
agagagcagaagtacaaggcagtggagctgcgtttgctggcaggcatctatcctccaggcataaaatcagaacacttttatctctaaagaactgaaaaactggagaaaacatttttctttctagtatacgggggtgccacctctatatctttccatacttctgataaacttcccataaacatagcatgcccaaacatattttcttgcttttttcatacatgtgattgggcaggtaaagggtcaaccagacattgcaggaaagctacacacataaataggaaaaccaagataaacataaaaattgatccaaaagaaatagagatgatataggaaacagaagaaaaaaatagtaactatcatttgtatcctgagaaagatttaagatagttatatccataaaagagtaacagcttggcatttattta

SEQ ID NO: 403145 - DNA, 378 bp, Homo sapiens
gggccacagagatgggtccatgacaaaatttgtgtcaacacttgtcaatcctaggggttttcttttgagttctcaggggagtagactccctgtgtatcactgaccatgaagctgaacacatgcagtcccaggagctgctggcagccacgtgcccaccaacaatcaagagctaagaattgggcaacatcatggaaggaagactgtggggaaaaagaaactgagtccctgctgaggcttgttgcttacctgaggccaaccatgcccttgaactcttctcttttgtgaagagatacattctctttacttttaaaaattcattttattgaatcttctcttccttgcaacctgtaaatatattcatattacaaagtcccaaac

SEQ ID NO: 403146 - DNA, 390 bp, Homo sapiens
agcaaaggagttcatgtttcatgaaccagtgacacttaatgctgattgttcaatgacttggatttcttaggtaatagctttacttgatatattgtgtatttttggtttaattgttggtcagtttggtattccatatggtagtgctactcaaaatgtgttgtgaacccttggtggcccatagagtcaaaactattttcataataatgctaaaacattatttgcctttttcattgtgttgacgtttgcagtgatggtgccaaagcaatagagggtaagactgttggtgccttagcatgaatcaagatagtggcaccaaacttgactagttatcactgtattctttgctatcacatactcactgttaaaataaataaaaaatttaaaaattaa

SEQ ID NO: 403147 - DNA, 340 bp, Homo sapiens
gcaccaccactgtagtgccctacaagagaaattcaatgcaaaggaaatttgtccttccaaaggggagaatactgcaacatgtttctaaaaagtaagttcttgtatccattacttatataaaagagatttgcatcttctgcctatatctgtaaatcaatcatcatcacgtttgtgacaaccattcataaagtgtacaaaccactcagtgggttcacattctggctcatgttatccaagcaacacttggaattatgtgtccttgggaaaaatataatcagtttcttcatttagaatatgtaataacattaccacctatccgactgctgtgaagaaaacataa

SEQ ID NO: 403148 - DNA, 717 bp, Homo sapiens
tatgtgaaaaatgagttactgacatttgtcaatcagtctttgccttattcctctggttggtgtgaaacaaagtggtgcagagaattttagactgttgctaccatttgtactccaaatgatagcatattcctgattttcaataaccagataaggatggacttttcttgcctgtgccaccaaatatcattcctaataaaacaccaaagtttatcatcttgtgataaacatagagaaactctattcaagataggtgcacatctacttgtaattagaattagttaatgagactaagcattctaaatgtcctgcttcacagcaggtactatggggaattgagttcatttggtaatatattttgattttgtctgatttctaataagactgatgaactatcccctaaacatttttattagcacatagtatgtgtcagctcttggggttgataccatgaagagtaagatacaatctcactacctagaaatgagtctacccaaatagagactctttttaatgctttcaacccataaaaacatttttggggggattctactgaagaagcaatggagacatccattggaggttaacagtattcctttgagtggtgtgattaaaggtgcttttatattttccaagtttttagtttgtttgttttgcagaaaatgtatttaatgttctataagtgggaaaataaagattttttaaagtgataaacaagga

SEQ ID NO: 403149 - DNA, 185 bp, Homo sapiens
ctctgggtctctgctctcctctgtgtcagacctaggaggcctgaggattacttagttgttctgtctctgggtccacaggcagaatttggcccatccaaagactggccaagtgccaaaaaaaggcctgattaggccctgaaattcagtgaaattctgcctgaagaaacctcttattgaatttgaaa

SEQ ID NO: 403150 - DNA, 427 bp, Homo sapiens
agggtgaataaatagacaatctgtcttacaggacataaaagtatctttccaaagagaaaaactgtgtttaaaatcatccatagcttttggttattaaaaatgttcacagggcctcaagcaatgtaacatagctccttcaatttttcactggtgtctaaaacctataaaatgtcaaaatattgttcaaatctcacctcgctgtgagacctgacctgactgcaccactgtttgaagtggcagcttcacgcttccttccctgctttctttttctccttaccatttgctgccatttgatatactagaaagtttacttgtttttacttgtcttctctcagtagaatttgagctccaagaaggcaggggcttttgtattttgtttttgttgttgttgttgcttgtttggttggtttttgagacagtctcactc

SEQ ID NO: 403151 - DNA, 564 bp, Homo sapiens
cgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccacccca

SEQ ID NO: 403152 - DNA, 1844 bp, Homo sapiens
aataataattgctgacgtattgactgcctagtatataccaaccattgtttttaagtgccttacatatattaactaatttaatccttatgaaaaccttgtgtggtagataggtattatcattacctccattgcccagataggaaactgaggcaaagagacttaatcacttcccacgggtcactcagctagggaatggcagaggcagaattcgaacctagcagtccggaggccatgccaagactccttagagacagctgagaaagcccagttcctaaaatatcattggctctccatgtccaggtttcatcctgtggcagacgccactgaaatcttctaaaaggataggatgcgagttccctcctttggggcaacagtcgtggtctgaacagagacgtggggagggaggcaggaaatgggatggcagctggaaccccagctaaggggtgggtagaggcttctccgctggtcgcagggactcagctgaggccttttctgcacggctctaacccaagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacgggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttc

SEQ ID NO: 403153 - DNA, 1632 bp, Homo sapiens
cgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaaggagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccg

SEQ ID NO: 403154 - DNA, 1627 bp, Homo sapiens
cgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacgggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttc

SEQ ID NO: 403155 - DNA, 1569 bp, Homo sapiens
cgccccgcgggctcccggtggctgcttcccgtccgctgtcctctgctgccagtcccctgccccgggcaaagcccatctggtccgccgagcaggccggagctattgggagtggcggatcctcccaccccagccggatctgggccatggccgagcctggagagggactgccagaggaggtgctggcactcatcttccgccacctgtccctgagagaccgtgctgccgccgccagggtctgcagggcctgggccgccgctgctacctgcagcgccgtgtggcacgacacaaaaatcagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacacgccccacccgctcggtcctggacacactgcccccctctcttgcctccacccctctgcggactctgcagctccgcggccccggcgcagggagagggagggcacgggcgcgggccgggcctcaagggacttgcccagcccacaccaggtcgcgcaccggcgatttctcctgtagaacaaagaaggaaatagagggaccgagaggggtgggactcgaacccaagtctcccactcatctcaccccaccccaccccactccaccccacccca

SEQ ID NO: 403156 - DNA, 819 bp, Homo sapiens
gtcccctgccccgggcaaagcccatctggtccgccgagcaggtaagacaccagcgcccaaggttagacggcaggaagacccgactttgggggtttgcgattcttacgaggcggggggctcgtaagagctacagctgccagacttcggtaaatcaagggggcgccccctggagaccagaattttctggtacccctggggatccggcttcaagatcgctgctaccagtgggcactcaaaacggggtgcccatgggtcccaggtacaagcccggccgaacgtatctgaagccccaggaaacacgtggcacaaattccgggagaaactgttagcccggaagatatgggaacattaactggcgagtagtgtgaagccttgtgtacacaaacctttaagaaccttaaaacaagattggcggccgggcgcggtggctcacgcctgtaatcccagcactttggaaggccgaggcaggtggatcacctgaggtcaggagtttgagaccagcctggccaatatggtgaaaccccgtctctactaaaaatacaaaaattagcccggcgaggtggcgcgcgcctggagtcccagctactcgggaggctgaggcagaagaatcgcttgaacccgcgaggcggagtttgcagtgagccgagatctcgccactgcactccagcctgggcgacacagctagattccgtctcaaaacaaaacaaaacaaaaacaaacaggattggcaacttcaaagaggacgcacactttccagtaacccatccccctctaaaggctgcgctccagggtgggtctgcggagttccagccgaaccca

SEQ ID NO: 403157 - DNA, 503 bp, Homo sapiens
aaaatccctgccaaacagcagttccacctggccttggaaccagcggttcccctggcaaacccttccatctgattgtgaggaagctcttcttactaagctcaaattgggttgtcctacaacttccaccctgagctgcactcctcagaaccatacagaatccctctcccctgtgacagcaattcagagaatggaggctgcctggttattcagaacagaatgttatggaaaggctcaggtctcaaggccaactactcccctcttggttgtgtaaccttgagaatgttacgtacttttctgagcctgattcttcaattgttttctagggaaatcagtgagataatgacataatttatctagcacagagaaggcactcagtaatgtctagttgctcattcagtcaatgattcattcattgaaaatagtcctttagttccaagttgttcccacatttaaacatcctcagttcccttggtggtgcctcatgctttccagtggtaccagaa

SEQ ID NO: 403158 - DNA, 300 bp, Homo sapiens
tttccctcttccctttctcctcccaccttgaacaggtatacacgtgcaaacacacaccacaacacaccatttcacactcctccatccaatggcaggcatcggggtcccatgtgacagatggacaggctcagtttttaggaagacttgtggggttggttacagaggagagaagtttctgcccagcgtgcttcttagccagactgataaagccctaggtctgaagtcagggaaggcttcctggaggtgatgtcatgactgggggcatggacatcaagtacagccttgaaggatgggatttga

SEQ ID NO: 403159 - DNA, 680 bp, Homo sapiens
gtttccagaggatcccctgtggagggagattccatgcttgtatgcatacactactgtagcttgtttttttcattttagaccttctctattgatttcctacgctgcaagatgaagcttcatctcttatataaccctcctctcacacgcacaattctttatactaagctctcaataccattttctaattttcttaatattcattgtttatattttcatggctaaatattgcttacagctgagcatatgcagtgattttatttctttgccagttcaaatttttcttttctctggagtcaacaattattttattggtttacatttcttagtaccagtcacaaattcaggcccccagtttctgataggactacagaactctgcagtcaacacctcactcatcctgaatcccagtaattttctgtgttggattctgagtcctggattacacattgtcttctctcttggcatgcctcctcattttgatggagcacatcctctagcagctttttgagaaagggtttacagggaggaaattctttgagagcttacgtgtctgaaaatgtctttatttgagcctcctacccaactgataggctagctatagaatgctagaatggaaatagttttcctttagaattgttacttttgagaagttacctttttttgagaagtctcaagtcttt

SEQ ID NO: 403160 - DNA, 1505 bp, Homo sapiens
ggttcgtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtgaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaagtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtgaaa

SEQ ID NO: 403161 - DNA, 659 bp, Homo sapiens
cggctccgttgctcccgcggcgcgaggcgctctcgctctcctgctcctccgccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcacatacggaatgtcgtcaaagacacgtacgaacttcggaactgtgcaaccagttaaacatgtggtattgcgtgttcgacgaagttactattacacaacatggcatgccctggtggtagaatccaaagtggttgtacgctacggcgtacgaagcaatgccagtggaccaaccacgacttggatgcgccttgccgtgctaacaccaccaagtatttcacctaccaagatccttggagaagcctgcgtaacccactttgcggccatgctcatttacacccacatttcttccccattaagactccgcgtttcaacccactctgctgcgcccaacttgctaacgaacaagaaccca

SEQ ID NO: 403162 - DNA, 1524 bp, Homo sapiens
ggttcgtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtggtttgtgtgttttctctagaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaagtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtgaaa

SEQ ID NO: 403163 - DNA, 1576 bp, Homo sapiens
ggttcgtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtgtgaattgcaaagccctgtccgtgatgtctcctacatgttgccttgaaactgtccatcgcctttcattactcctgtgactgccctagttcaggctgccccgtctctttatgtagatgctttttaaaacaatctcatgacttgcttctccaactatgagagagcttttaaatgcaacttttacaattttacacgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaagtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtgaaa

SEQ ID NO: 403164 - DNA, 524 bp, Homo sapiens
aagtataactcagtccgtgtctctctctatcttgagagccagtgaagccaacagggagtgtgatactgatctctctgctacaagaggcctgcctccatgtgagtagacctacagttttccagaactgcctgctgctgaatgggttaagtctaattccagtgctcaatattacgaagcccgctttcgtgaagatataagccatgtcttccaacattggctttgtcaatccatgtgattagatatgggcaggtgccgggtgggcaagtggtgctattcattagtcttcctcaaaccccagcacccctctgaagaaagcaatcttttcttatttatccctgtatcaccacaacatgatatgtttgcgataaatgtttattgcatggatgtaattgagataaatttacttttctgtccttggccaagggggatgaactagttgatccctaacatgtctctctgtgtaaatatcctctgacacccttaagctgtctcaggtataaattatgaatactttctaaaagatt

SEQ ID NO: 403165 - DNA, 360 bp, Homo sapiens
aaaaaccttttactgttaaaattatttcttcatatatatatatatatatatatatatatatatatatatgtgtgtgtgtgtgtgtgtatatgtgtgtgtgtgtttggtgaaaaacatcattttacagttcttgtaaagctgtctgtctcctagaaccttagtgtctctgtaggtagtttgcattgcattaagaattctgtgtgacagctgacagaaatccaacccccgaattatcacagggtactttcctatcaaaaagtatacttgggttttgtaagtattagacctggtatttttcttttttggtattttatctttagttttaatgttgtagtaaatgtttaccttttattttctctt

SEQ ID NO: 403166 - DNA, 469 bp, Homo sapiens
taacaccgcttaaagattagccactgctagacagtgatcctcaggtatatggtctcaggattggccccaagcacacggtgtgtgtgtgtgtataaatatatcttcacaaagcataggtacccattaaagccatattgctttgctgaatggttctaatagctacagatgatttctagcctgaaagaaaagcaccacgaattgtttgaagttgacttgtcagatgtggcatgcttggtctaagttttgacaggaagggtatgtgggtaggggtgtacggagcatctcatgagaccagttctcctcctgagaggtccgtgatgttggaactgttgccccagatggactttgcccttgtgagactttatacttttcaatgcagtttttccctctttaaaactcgccagcttttatgtagtgttttataaaattacaggaataaaaagaatatcttttatgctttttaaaaaaa

SEQ ID NO: 403167 - DNA, 284 bp, Homo sapiens
caaggcgctgcaggtaaacataaggaaggtattaaaagtagctaatatttatggagtgtttcctgtgtgccagactttgttctaagggtttcatatgcagtaacttatctgattttcataaaacccttgcgaggtggttcctatgactgcacctgtttatactgttgaggaactgagacacagaaatgtttaataacttgccccagggttgcacaactagagagtggaagagctgggagcaaatcctgattccaggcttacagtgctaactatgtgttctatgg

SEQ ID NO: 403168 - DNA, 902 bp, Homo sapiens
cttctataatcttcgtaacaacatgaaatatgtattattgtccttatgctacagatgaaaaaactgtggaatacaggggccaatgtgtctctagcctcatttaataagaggtggatctgagatctgaacacaggcaattggatctagaatctatgttctttaccatgaaactatgttgctccctgtctaaatacatgcattaaacaaatggtaaattataagcagataatttctacttaatggttcaaatggtaaattataagcagataatttctctaaaaatacaaaaattagccagatgtggtgatgcacacttgtaatcccagctacttgggaagctgaggtgggaggatcgcttgaacctgggaggcagagattgaagtgagcagagatcacgccactgcactccagcctgggcaacagagcaagactccatctcaaaaaaaaaaaagaaaagaaaatcttctatgttataaacttaaatttcatgtgaatggaagattgagaaatgatggctgatggcctaagctctgggtagaatttcaactttttgcatgtttatcaaatggctttaatgttcctgccttttcctggttattatttaaaaaaaagtaatgtttccagaaaccatttaacaactgataactggaaaattttttggaagaggttagctagacaggttatacgggttttttttttttcctcatacagtttttttaaaaattgagaaataattcatgttttctttttttttttcagtatacaattcagtggtttatactatattcacaaactgtgtacccatcacatcactaattccagaatattttcatctcctcaaaaagaaaccctgtacccatcagcagtcaccctaattcttcattttacttagccccgggcag

SEQ ID NO: 403169 - DNA, 294 bp, Homo sapiens
ctaaaactactaacataaagcaacaacaaaaccccagaagatttgaaaagggcacgttaaactgaaatgtctaaaactagtgtttctggctgtccgtgattctagttggctctgtttccacctgtgtgcaaatgtagtccccaatttctttaaattcctggcccattgcatacagttctcactaataatacttaagagttcctagagttgccagataaaacacaagatgtgaactgagtgaatgagtaattacttagtatatttcaaatattgaatgggacacacttatactaa

SEQ ID NO: 403170 - DNA, 413 bp, Homo sapiens
tctgctttatgtgtttctatatgttatttggcacaaagttgttcttatgtgaatattattacttttgcattatgaagtgtctttcttcggctcatttaatgcctttttggcctgaattcttccttactgcatgtcaaaatactctgctttctttttgtttgcatttatttgatatattcccattctcgactcccctcctttttatctgcctttctgagtcactttgttttagatgtatctcttatgtacagcctagagctgggttttgctttgtaagctagtctgaaagtcttttttatttagttagatgagtcatgtccatttatataattgatatgactgatatgtttagtctcagatttgtcattttattttatatttactgtgtgtcttctactatttatttgggtttt

SEQ ID NO: 403171 - DNA, 253 bp, Homo sapiens
tgggttccaacaaaactttatttaccaaaagagttagctgctgggtttggccaatccttgccttaggtcagtcaccacgtcactgagtacttggctgccctaactaaagttggattctattagcaaagaagaaagaggaatggctatgtgtagagcctgccacagggacggtggctccaaaacactcccgggagagttgagatgtgacactgtgagaaccagatactgatggaggactgtcaggaagccaggg

SEQ ID NO: 403172 - DNA, 432 bp, Homo sapiens
ctgtcttcagggattagcttaaatgctgccttccaaagtctcgcctagccagtgatatgctaataaatgtttaacaaatttctctatgaaaaaaaagggccttgatttgtagcatttgtcagttccatgatataagccctgattcaagcaaccactctggacagtgccaaatgtgcagtcaggaagagaggtacgtgatgagctcccactagcaagtgggggctggctcctgtaccccactgctcctagctctgctgtcagaattgaaccaaatttcttgacccataatgctgtttctcagtttatattaaagcatacatctaattctgcctgtctggtctaccttttccacttcaactttaagatccttgaagaccagtattgaattgtatttatccaacacagagccttttacagaatggtaaactctgt

SEQ ID NO: 403173 - DNA, 1298 bp, Homo sapiens
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcatt

SEQ ID NO: 403174 - DNA, 564 bp, Homo sapiens
acttgcacatggcctgggcctttgggctccccactgtgaggcctctcacggtgggacccaggctttgggtagctggctccatgctctagcaaagcctcacttagcagtggggaggtcccaagaagagaagcgagatacccatataaagcaagcctgcttagccttccagggtccttcaaatcttaccaaatgaaagccagcttgctccacctactgtcaagccagcatctcattctccccattcttgtctcttaaacaactactcaaaaaaggagagccatgaaagtcaccagcctagaaaattacagtcgacttcatgagcttcatttggatttctcatcatgcaatagcaaagtcacagttattcctactgagatcacaatgatgctgccagagcctcccctgagcttgagagccctcctcttctaagcagcatttggagcatcctccattgtatagtgggaaagtggatatctggctttccttccttcctgaggaaattatgaacaagaagaacaaactccaagctaaatacaagtcacgacttttccagaatccaaaagt

SEQ ID NO: 403175 - DNA, 6337 bp, Homo sapiens
  misc_feature (6239)..(6239): n is a, c, g, or t
  misc_feature (6298)..(6298): n is a, c, g, or t
actgcaggccaggtaccttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtgaaaaaaaaaaaaaaaaaaaaaaaaactcgagctcgtgccgaattcggcacgagcggcacgaggccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtggtggatggtgggataatagatgtcatgcagccaatccaaacggcagatactactggggtggacagtacacctgggacatggcaaagcatggcacanatgatggtgtagtatggatgaattggaaggggtcatggttctcaatgaagaaatgagtntgtgtgacacatttttgacatatgttttggattttcttt

SEQ ID NO: 403176 - DNA, 6624 bp, Homo sapiens
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403177 - DNA, 6339 bp, Homo sapiens
ggccgctgtcgggctggccatggcgaggggtgcacggcggccacctgagtggcgcggcggtgtcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403178 - DNA, 6101 bp, Homo sapiens
actgcaggccaggtaccttagcaggtctttctgcagggctgagctatcgctagggaacccacggtgactgaatcaaagggaagaaagacccaagacctggatctcccttttacatggaccctaaagcaaaggtcctgtaggtgaaaaatgttgaagagcctctcactcagactgagtgaatatgagaagaactagatggaaaaggcatcctcactaccgatagcaaggtcagacagtgttaggatttgtgccggaacatgtgtgtgtacatggcatgcacatgcacaaaaaggcgttcaaaaatcatcggtgagtcactcaaggagcacactgccattcactttgtgattagcctggaaaggagcaatttcatgtctcgtttctgctgaaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403179 - DNA, 3561 bp, Homo sapiens
actgcaggccaggtaccttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgctctaaggtcactaaccagagggactttaaaatttcattctctgtggaacactggtattcggaagtgttactcctcaatccttatctcacttcgactattttctaactcctctaatgtgtgtaagggtttctcacaatgtgaacagggcttcaatgtatcccattttcactctttggtacatatgtatcagttgttcg

SEQ ID NO: 403180 - DNA, 1053 bp, Homo sapiens
ccgctctagagtatccccgccactgaagagttttagcactgatcaacactgtatttcctagggcagaataaaaggtatctggtttgccttaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403181 - DNA, 1391 bp, Homo sapiens
acttgcacatggcctgggcctttgggctccccactgtgaggcctctcacggtgggacccaggctttgggtagctggctccatgctctagcaaagcctcacttagcagtggggaggtcccaagaagagaagcgagatacccatataaagcaagcctgcttagccttccagggtccttcaaatcttaccaaatgaaagccagcttgctccacctactgtcaagccagcatctcattctccccattcttgtctcttaaacaactactcaaaaaaggagagccatgaaagtcaccagcctagaaaattacagtcgacttcatgagcttcatttggatttctcatcatgcaatagcaaagtcacagttattcctactgagatcacaatgatgctgccagagcctcccctgagcttgagagccctcctcttctaagcagcatttggaggttcttgctcaagtaccaactctatggacccaggacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcattaaatgtccatttaattcattggccgtggatttaaagaccacacttctgaaagaaacctcagtgcaagtctcagccactggctgggattcctggagacctggctgcagtttctaggctgaggcagggagggagggaggatgcaataacaaggaaggatgtgggacaacaggagactgcttggtttttaataaatgcatttctgaccaaaaagtgtgag

SEQ ID NO: 403182 - DNA, 6205 bp, Homo sapiens
ggccgctgtcgggctggccatggcgaggggtgcacggcggccacctgagtggcgcggcggtgtcaggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403183 - DNA, 5839 bp, Homo sapiens
actgcaggccaggtaccttagcaggtctttctgcagggctgagctatcgctagggaacccacggtgactgaatcaaagggaagaaagacccaagacctggatctcccttttacatggaccctaaagcaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403184 - DNA, 6512 bp, Homo sapiens
ccgtaatgtctggtgatgttccccagcctgtgggaggcagatgagattgaaaccagggtgtacatgagtgacctggagcccataagtaacagtaacacagagcagagagcgctagatgaggtggagctcagaggagcatgggaagttgaatgagacagtaaggagcattctggaagctataatgggtagttaggagaatgccagagtgattctgatgcagtccttccaaatgccggcagagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403185 - DNA, 6324 bp, Homo sapiens
ctgagatcgcgccactgcactcgagcctggtgacagaacgagactctgtctgaaaaaaacaaaaaaaagaaaaatgatactaatatcctagaaccttacctaggtacactaagactactgttagaaccaaactaacaaaattataattttcattaacaactgctgccatttactaagtcgctgcaccaagtgacatatattatttctaatccttataataagccctacagtgaagtgttattaatcctcatgtatacagatgagaaaccaggtgaaaccagagggtatgacacaaccagagtgtggccagcgggtattcattctccctctgtgccccaccacatcatcctttaggtcctgtaggtgaaaaatgttgaagagcctctcactcagactgagtgaatatgagaagaactagatggaaaaggcatcctcactaccgatagcaaggtcagacagtgttaggatttgtgccggaacatgtgtgtgtacatggcatgcacatgcacaaaaaggcgttcaaaaatcatcggtgagtcactcaaggagcacactgccattcactttgtgattagcctggaaaggagcaatttcatgtctcgtttctgctgaaaaggaaaatggcaaatgcacgacagcggcctcctgaacatcaccaaggtatccttctcagaccgaggtaaatacacgtgtgtggcttctaacatctacggcaccgtgaacaacacggtgaccttgcgcgtcatcttcacttctggagacatgggtgtctactacatggtcgtgtgcctggtggccttcaccatcgtcatggtcctcaatatcacccgcctgtgcatgatgagcagccatctaaagaagactgagaaggccatcaatgagttctttaggaccgaaggtgcagagaagctgcagaaggcatttgagatcgccaagcgcatccccatcatcacctccgccaaaactctagagcttgccaaagtcacccagttcaaaaccatggagttcgcccgctacatcgaagagcttgccaggagcgtgcctctgccgcctctcattatgaactgcaggactatcatggaggagattatggaggtggttgggctggaggagcaggggcagaattttgtgaggcatactccagagggccaggaggccgcagacagggatgaggtctacacaatccccaactctctgaagcggagcgactcccctgccgctgactcggacgcctcatcgctgcacgagcaacctcagcaaattgccatcaaggtgtcagttcacccgcagtccaaaaaagagcatgcagatgaccaagagggtggacagtttgaagtcaaagatgtagaggagacagaactgtcggcggaacattcccccgaaactgcagaaccttctaccgatgtcacgtccaccgagctaacatctgaagagccaacacctgttgaggtaccagataaggtactgccgccagcttacctggaagccacagagccagcagtgacacatgacaaaaacacctgcattatttacgaaagccatgtctaataccaaccccgaaaagctatgcatatcaagaaaatcaggggctgctccttgtaatacagatgtagtacgcacttgccgctaagccttaccaggagactctcatcccttaggtaggagtgatgccactttaaaaggagaaacacctgcctgcagtgaatgggactggaatttccccagtagagaagggtgcgagaaacatcagggtgcagaattgataccagacagaaggtgtctatgtgataatgagtttcagaggctgatctctgccaaataccttaattggtgatgccttcttggcaaagagtacaccactgtaagatattctgagttcaagaaccctgtccagtgccccctgcattgcttttccttttaaaaagtataggtctgctacaatagcaaatgcacgtacgtgggttttttgcagtttcttctcagttttaattttgcttttcctttataatggggtcattgttattaatactaattgttctttctggtttagtcctcattgccacttttgtccttatgtttccctagaacacgtacctcagagactttggtatcagtcaccagtaccagggctgatatctacaagtcacattacatttgtcatgttccaaagtagttacgaggcttgttatttttttttcattccccaggcctatttccatagatagctttttttgtttgtttccaacgaagctgctgttaaacgaaactgagaaaaactttgccccggaatagcactttaatagtcaaaaatgtgtttacctgtctgattgagtgagccttttggtgagctcagctgagatgtagagggagattgtaaaaggttaaatatacccacaccacccatgaaagtcactgtttaagttacatcatcctccaaataaagactgattctttacctggaaaatatattgcttccaaagacatcagattcagtggattcctgtaggttatagaatattggcttccaaacaggcttgcagggaccatatgctgttggatgacatataaccaggtccacttttatgaactgcatagctgacttggttgtccttaaagaggaaagcgaaaggttagggtaatagcaaagggaactgtgccatcagattttatgccaaaactgttgaataattatgcagtcctgcaagaaagtggttatatgtgaggtgcgtgatgttatggaaagaagacaaaattagtcatccaaaggcttaatacccactgtgccaataaccagctgcctggctttggacaagtctggacctcaggtcccttatctgtagaaggggcagatgacatgagctctgagcactgttgaaatggtatcactgtcacacagaaccaaaccaatattcacatccttgctccttttcacaatgactttaaagatttttgctttcatctcttggtccacctaacattttcatgcttcattacttaaataagaatgttggttttgagaaatagcattttaaacaaattgtggatcttctccttccaaaaaaaccattaggaccacatctgcaattaagatttaatattggtgagaatgagtggttttatttaattttcccttaaaagcaaaggagacagtaatcttaataaattcataggggccgtggccacatcaggtaatggggttatgatgtccaagattgcatggatcacattggtgatgagagcagacccagatgtttagtcctcactctgtcaccatctgaggaggtgaccttggacaactcccttcctctctctgggatttaatctttttcatctgtaaaatatgcaggtagtactcgagggtctacaggatcccttctagttgaaacatttatagttcacagaaagtttgcagtcttccaggataaccaacccccgttgcatgagacaagcaaaaaatgggtccatgaaattggatacttttgccatccaaactttacaacaaacattatctggctctgtaattgagagcagtgggcttggttttaaacctagccttgattagtttgtttatagataactgttgtggaaggtgatagaactagtcatggagtttgatgagacatctcttgaaaaggactgaactgttgacttctggttagaagtgctttgggcagtcacataaagaaatgagcagtgagaaatcaggagaaattatgactcctgttgggctttctggactagcattgtatgtttttgggttgcagaaaagttttaacaccacctcttagaatataaaaattttccagttgtcatggaggtccacagattcattaccatgggtttatatgcccaaagcaacaacagaggacttaagttcattttgtgatactgtatggatgttaccccatcctattcagttgtcattccacccaaacccatgtgtaggtttccacatggaaaggagaaggcatccattccacctagacattgaatagtgataataagctaaaagtgggcagattttcagtggagcaagagcagaaatatgcggccaaagaatgtttcctgattggttttgctgctttagactgcagtggggagagcttatgtagattttcaaaactttctccctctttaaggcatcataatgctctcggttttgataacaactgacataaagggaggttgacttaaaatgggaatttctccttccaaaaatgctacactcttcctatccatcctacagcttctttatgaaatgagaggccctcctgctagaatatgaaatgcagaagacctcatgactttcagctgatttttcaaagataaagtgaactgttcagcttcatagaaattcatgcgagtgtgactgaacgtgtgtgcatacacactcgtgcacattggactcatttgggcagttttaaaagcttcacactaaatccaaagcctcgtcctttgggtcgtatgtagtcgtttgtaaaatcaatttctggcttctgagtcatcctggtcatatctctagcaatgtttttcttgaaattctgaaaatgattcacatatgtgtgtacatttaattcacttagatgatctgtaaacttggatggtatttattctaaatggggaaaacaattttatatggaaaaatctatgtaatttataatggttttgttttatatattatattttcatatctctagggcacatctatcctcatctttttgtataccatacttagcaaaaagaaatactaatacttgactaaaatctctaggaaccaaacgtgatacatgtgatatatagcttctagaaatcgctctaaaaatctctgaatgtctcatccatcccaagcattattgtgctgtgtcattatgtccagaatgatttgtcttggatgcttatgagcatttgtttttcacaactaaggttgaaagacctgacatctcacacaatggggttctggaattcccctttcctcctttatctgtttttattgtttgtttcatttttaattgcaccagtctatgttgtcgaaactttgttttgaagggcaaatgtgagataacaagaaagcaatgtgatggaaagactggatgaatttacctatggctatgtaaattattttaatggactgataagatgtttcaagtctcatgcttggatctttatttattggtgatctaggatctgctcagctctttagcacatgaagaaaatcaggtacaaaggacatttgcatgtttggaacagcatgctctaagccccgtgcagccaacacaaattaacttgactgtagaaacaccaattccagctgctggaagaaatggtttagaaaggcaaaccagataccttttattctgccctaggaaatacagtgttgatcagtgctaaaactcttcagtggcagtcactgtggttcttttaactggggatttcctttcagtgtttcatttggtaccaaaacagaacatttaccttacatttcagatactctgttttctcagcattgttcagatactttcctttaccgctcttcacgtacccttttggcattgagtaattctataaatgtttctatccttggtttttaaaccaagttattcatactcttaaaatatctaccaaatctcattgtattttcacatattttgagcatcaagatactggtcattttaaaaaatccttcagtaaatagcacagtttattttcctaatgacatttttagggtttcttcattgatcaaccaggtttgggttacacaaatcaattgtgggggaaaaatcaaataaaacaattgcttattatattttccaaaggactgagcatttatcttttattcacgaagatatcatatgaggatgataatgatctttaacagattttttagagatagaatttataaagaggctgatactaagaatactacaatcaaaattgaagctagagaatgtaaaaatagaaagtaaatagttctaagaatattctggcataaattatttttatttagccaataaaatagcctccaaatgtatatctcagacaccatagagctgctaacaatgagaatcaaggaagatgcttgcacttagatttcgtttgttgtatttcagtagttctggatgtcctttgttaaaattggaaaatggaaaaatgtctcgacagaaatgtcaatctggtgattctgtgaactgtaaaatgttcacttttaaaaataaagttgtaaacaagttactcatataagttggtattacagtagcaaaaacagaaaaccatgtgatccatcctgtattttgattgatgctttaataaagggtttgcacagctgtg

SEQ ID NO: 403186 - DNA, 1515 bp, Homo sapiens
gaggagaagaagccactaacattgcaggatcgtgtagcgaaacttctgtaggtacttaataattttagagtactctactttttaattaaaaaatcaacttatggttcattagaaaaaacgtggaaattacaaataatatttttaaagaaaatgaaaaaaaaattcctggaaccccaccactcagaaagtcaccagggaacggcccgctgggtttttttccagactcttccatctgtggactttgctttaagagacgtttaagacttacagcgcagtcgcccgggaaggcctgagaagctttcggaagcaaggtggtttgctcgtgattgcatttgattgcaaggagacaggagcccaagctgtgaccagtgacgcagactggaagtcccgtttactgggagagaagaggttaaggaacacccaggtgaacaattaggtcctccacaatgaagacaggtaatgtggaggaaagagagcttgtcatggttcttgctcaagtaccaactctatggacccaggacaggtttgtcccatgacctgctgtgaacagtgtgttgtctgatagaagattcggttggcaaaccatctctctattgccttacagagcaagcaaagaagatggatcgattgaagagccatctgactgtgtgctttctaccttctgtgccctttttaatcctagtatccactctagccaccgctaagagtgtgactaacagcactttaaatggcactaacgtggtcttgggctctgtgcccgtaatcattgccagaactgaccatatcatagtcaaggaagggaacagtgccttgattaactgtagtgtttatggcatccctgacccacagttcaagtggtataattccattggcaagctgctgaaagaagaagaggatgagaaggagagaggaggaggtaggctttaaagttgtatcaaatgtcataataaaatataaacaggagctttggagccagcacccgtgatgttagttcttctcatgcaaatgatttaaagatctcatcttgtcttgtttttctaaggcaggagagaatatatatccttaaggattcaaagaagcaattaattcatttttttccctcattgacacagaagacaaaggacaaacacagaagtctttttaaaggcttcttggaattttgtaatataatacatccaatacattatagagacaaatgtaaaatggattttcctaaataatatattcaatttttaagggagttttgttttctttcatggagatggctggaataaacaatatagccattgtttatcattaaatgtccatttaattcattggccgtggatttaaagaccacacttctgaaagaaacctcagtgcaagtctcagccactggctgggattcctggagacctggctgcagtttctaggctgaggcagggagggagggaggatgcaataacaaggaaggatgtgggacaacaggagactgcttggtttttaataaatgcatttctgaccaaaaagtgtgag

SEQ ID NO: 403187 - DNA, 782 bp, Homo sapiens
aaatagattcagagaaacatacacatacacaaaagaaaataagaatactgtgatagccttttgaaatgtcaacttggataagctagtaatgaaacactaatctagatgttgctgtgaaggtattttgtatgtgattaaagtccataataagtttactttaagtaagagattaccctagataattatggcctgattcaatcatttgaagggtcttaaaaagcagagttgagacttccctagtaaaggagaaattctgtgtgtggactgcagtttcaacctgtgcctatgggttctaacccgcccttcctgatggaacagcctatgaatttcagacttgtctagtcagctccacactcatgtaagctaactatttataacatgtatctcctactgggtctgcttctctggttgaaccatgactgatacaaataccatgtccatacaacaatgatactgaaatctttcctaaaattgcttaatgaataaaaacttccaaatttattaagactaaatagcattaagaccaaatagactactgccaaatatcaatgcttcaaacactttctagaaaaagtaattgataaatgaagacatacagagatggaaatatttatttatttttttagacagaatctcattctgtcaccaaagacagaataaaatggtacaatcatggctgactgcagtctccaactcctgagctcaagtgatcatctcacctcagacttaaaagtagctgggactacagatgcatgccaccatacctggcttttttttttttt

SEQ ID NO: 403188 - DNA, 455 bp, Homo sapiens
ctcccctgacatgtcatttacttgaattgaaacaaaagaaatttaaagcactgttttcttctatattccttccctcttcagattctccttatttaataaagcaaaattactttgacttctctagtttagaaattacctgaaattaaaacagaaaatggtcgggtgcagtggcatgagccaccaggtccagctaatttttgtatttttagtagagatgggccacctttgagtagcactgtttgatcctatcataacatcatgcctagtgtgctagtttgcatccattctaggaatggcaggcttgtcttctcaaataacatgtatcagttcatctgtggtatataccattttagaataaatttgaaaacttggctaggtctgactttgctttttaaatgtcctctaaatcggtgatgaaagtaactaaagagttaaattcctttaaaggaaagagc

SEQ ID NO: 403189 - DNA, 305 bp, Homo sapiens
tccgggggcattccactggcaaagggaagaaagcttcaggtgggcatgcatacaacactgcacatgctcacctcccaagggtaaggaggccactgtgtgtgcaggcagatcatccttaaagaagaatgaagggaaaggggctcaagatgccggaagtgggccagcatataaagtcttaggatcaacttagggtcaaggtgaaatggggcacttgtccttcaagtcacccggttgggtcccttccaagtgcactttcctttctttcctgctctaaagctttttaataaacttccacccttactctc

SEQ ID NO: 403190 - DNA, 455 bp, Homo sapiens
aaggtggccttctgtttttcacataacatcgctgtgcctcggttccttatttgtaagataaagagattatattcaatattctgtcgtgtaattgaggtggcctgaagaatgacgtgactggggagaacaacacggctctggcaaggatgtattgttatttttgtcttgctcatccaaatagttcatcttcctttatcttggtccatttatgctgttgtaacaaaatattcaagactgggtaatttagaaagaacagaaatcaattttctcacagttctggagctgagaggtccaagatcaaggcatcagcagatttggttgtttggataagcgctgctctcaagtcgcattgctgcgtcccacagtggggagggatgctgtgtcctcacctggaggaaggcagaaggcaaacgagctaactccccatgaagcctctttcataaggaccttaatcc

SEQ ID NO: 403191 - DNA, 633 bp, Homo sapiens
ccttgggaaggtaaaacaaagatgatttattgatgggaaggatggaattgatagaatgtgagggaaagggagaactcaaggggaatactctgattttttagcctgtcattggttggatggtgaagcaggcaacaaaaatgggggggcctgggcaaagattaggggggggggagccagagtttcatttggagctcatcagtttgaaatctcagtgagacttccaaattgaataggcagttggatgcagagatgtggagcttgggcctggagatgcacattgtttggagatataaatggtgtttatagacctatggttttataatacatcccttggagagatagagagaaaccagagccaaagaccgaacccagggtcactccaccacttggaggctgggccagtggctggaatgcacagcagcacggggcctggtgtatagtaggtgttcaacaaatctttgttgctgaggaaatcagcaccagcagtagtgactgcttatgcagtttctggagcagcttgcttctgaagtcagattcatggatatcacaagctcgaagacaaacgaacagagatgttttgctcactttagttaatagatttgatcaattaaacctgtttttggaagtgaaaaa

SEQ ID NO: 403192 - DNA, 320 bp, Homo sapiens
tggtcacttcattccatgccaccgtggtggagcccctgagccaagagctcaggaaggggcccagcagctttcacgctcactggtgtgcgagttgtacagtagacgtcacacaagtccatggattggctgagtgtctgctgtcacccaaatttcagatttttgaatacaaaaattagctgggtatggtggcagtcgtctgtagttccagctacttgggaggctgagacgggagactcttgaacccgggaggcagagattgcagtgagctgagattgtgccacagcactccagcctgggtgacagagcaagactccatctga

SEQ ID NO: 403193 - DNA, 462 bp, Homo sapiens
gatatgttgtgtcactatcattcagttcaaatacttttctaattttcctcttggtttcattgttgagccaatgatcattcaggaggaggtcatttaatttccatgtatttgcatagctttgagggttccttttggagttgatttctcattttattccactgtgatctgagaaagtacttgctataatttcaattttcttaaatttgttgagacttgttttgtggcctatcatatggtctatctcggagaatgttccatgtgctgattaatataatttttattctgcggttgtcaggtagaatgttctgtaagtatctgttaagtacatttgttctagggtacagtttatgtccattgtttctttgttgaccttctcttgatgacttgtctagtgctgtcagtggagtactgaagtcccccactattactgtgttgctgtctatgtcattccttaggtctagt

SEQ ID NO: 403194 - DNA, 381 bp, Homo sapiens
actgcactccagtctgggcaacagagcgagactccgtctcccccaaccaaaaaaaataaaataaaataaaagtggtatgcatatatatgtatgcagaaaaaacaggaaagaggaacagtttttttttcttttttgcttatttgtcttctaaattttctatattctaagtgttctataatccttttataattaaagaaaaaaattttaagttttatttcaggacaccattggaattaatactgaataaattaactaaaatgaggctgggtatagtggcttatgcctataatcccagcactttgggaggccgaggtgggtggatcacttgaggccaggagttcgagaccagcctgggtgacatagtgagatcttgtatctgca

SEQ ID NO: 403195 - DNA, 466 bp, Homo sapiens
ctcttcctgtgcctggtaacccctgaataactactgtgtagttaatcctttattgcctctgtaagagaatgctggaggtcaaacatagcagagattaataataatatgagtgataacggataaaacgcgtagcactgactacctaccaggcactgtcctgagtgctttacatgtattaacccatttaatcatcagtcaacacagcatgatgttattggtagatattattattacgtatatattctacagatggagaaactatgacctagagtgaccccaatgtcaccagctaagggtggggctgggtttaaaccaggccagtctagcttgtaacctctatgtcatattggaatagactctagcacagtggttataggttcctactaaaagaggttaaaaaccatgacagctatgctttaagaatacatacttgaatgtaagtgttagccctgacatccaatttgtc

SEQ ID NO: 403196 - DNA, 460 bp, Homo sapiens
gctgtgttgactcctaaatttatatgtgaaggtcagagtaaagagggcaaagtcattagtaagagtttagcttgagcttttaatcaataaatcagatacgaaaatgacccaaagacctagtgagaaagattacatggaattacagtcaagtactgcttaatgatggggatacatttcgagaaatgcatcgttaggcaattttgtagttgttccagcatcatggagtgcactttcacaaacctagatggtatagcctaccatacacctaggcaacatggtatagactattgatcctaggctacagacttgtacaacatgttactaaatactgcaggcaattgtaacacaatggtatttatgtatctaaacatagaaatggtacagtaaaaatacagtaaaaagatttaaaatggtactcctatataggtcagctccataataaatttagggaaccactatc

SEQ ID NO: 403197 - DNA, 471 bp, Homo sapiens
gcaggaagggagagcagaggaaacagaagttgcttaggagggagttgggcaggctctgtccccagcagatccaagggtccctgacaaagagaacacctcacctccgcccctccccagaggcacacagaatgccccctcccaccacctccaggctgttaattcacacccacccaggctgcccccaggctccccagacctgtgccagtcaagcctggcctgtggctgtgacacctgcattaccccagacggttgcctgacctaggcctgtccttctatctgctttgtttttatgttgattactaggtgaagcacagtgttaaaaacgggaagaaaaggctaggaatgcagttatgggagtgtgaggctgggttggaataggtgggagaaagtccagggctgagtgtgtggaccctgctctagggatctgaccggctcaagctcccaggccattaaacaaagttgttaatgtca

SEQ ID NO: 403198 - DNA, 438 bp, Homo sapiens
cacagggggtcctttctgctctgactcctggcttctgctgccagggcttggaggcttggaggtggcctctgtcccaacaagagtcctcaaaatcctcagtttgtccaggtgagggatcctgggtgggggaggttcccagggctgcggcagcacagaccataccttgtcagtgtcaagccctgactgacccaggagtgccaggtggtggtgtgctcactgccagaaaggggccagtatttgaagagcagtggaatgtgctgggcacgctgtgcaggcattcctcagccctcctggggctctaagggtgttattggggtatgctgccatacagaatattagaaagcaaaagaaagacgcggttgtcgggaggcagagcttgcagtgagccgagatcacaccactgcactctggcctgggcgacagagcgagactccgtct

SEQ ID NO: 403199 - DNA, 250 bp, Homo sapiens
tactatttaacaagcaaattgacctctattatttcttatatgttgataaatacaacatgtctttgaaaattatgtttcacattgtattcttttgtgggggtgtttacagttttgtttttactttctttggaggttattcagtttggcatgatagctctcctcagtaacgctttatttgtctgtgtgccacttttcactttctttttctcaatggaacctagaagcattaaacacatctcttaattgttaa

SEQ ID NO: 403200 - DNA, 1403 bp, Homo sapiens
aacgggaatggtttttaagactaccctttcgagatttctgccttatgaatatattcacgctgactcccggccggtcggacattcctgctttattgtgttaattgctctctgggttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgct

SEQ ID NO: 403201 - DNA, 624 bp, Homo sapiens
  misc_feature (22)..(22): n is a, c, g, or t
tccgggaaggcgacccgcgcgncgcccgcggcggagagcggcagggggggcgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgct

SEQ ID NO: 403202 - DNA, 103 bp, Homo sapiens
ggcaatagctttaactacatttataaagtcatttaaaatataacaacataggaaacaacaaaaacaatacaaagtgaagcaactctaatacagtaaaactttc

SEQ ID NO: 403203 - DNA, 471 bp, Homo sapiens
cagttcaatcaatgccactttatgtgattaggtttctctgtgtaatctactgatttcttctttcagtcaacatttacagggtgcccaaagtgtaccagatactgtgctagaccctgggaatataaagttaaaaagatctcaagttgttcacagtctagcctggagaaaaaaggagactaaacaatccattgtacaatccactgtaatccattacaatacaaaatgaagagccctggaatagagataagaataaagtgctatgcaggaacagaaaaccaaacaccacatgttctcactcacaagtgggagttgaacagtgagaacgcatgggcacagggaggggaacaacacacactggggcctctcgggggaggggcgaggatgacaggttgataggtgcagcaaaccaccatggcacatgcatacctatgtaacaaacctgcacattctgcacatgtatcccagaactta

SEQ ID NO: 403204 - DNA, 527 bp, Homo sapiens
tctggctttgccctggaacctgggatgaatccactccgactggatgtgagtaccaggtattatctgagaacgtgatttgaaactgctccctagatagggcccattccttagtcaggggttcctagtggctgtggaataattcacatttgtcattagactgtaaggaccatcactttattgcttttgtgtcccttcattgtgccgagccatgcaccatgcatccagcagggaatcctgtgagtgccttttcacaaaagcttccagctgcacgaggtcggcccttagcgcttttaaaggtaggcaactgacatgtccactcaggacacagaccccagcaaggtgctagcaggtcttctcagggctctcgtgatggttccaggcccagtcattggtcggcgatccagaggagacacgctcctcacttttggaattctacactttagaggaagaacccaaacgaaaagctaggagacaagccagtggggtgaggaacagattaaagccacttgcttctcaaatgaggacat

SEQ ID NO: 403205 - DNA, 461 bp, Homo sapiens
tgagatttaaaatacactgctaaagattaagagcagatttggacgctacagaagaaaagatcagtaaacaaagatgtaccaatagaaaatatccaaaatgaaacatgggaaaggaaagggtttctaactatgaaaaaaatgcattagtagaatgcgggacaacttcaattattttaatatacaagtaatgagagtcctaaaaggaaagaagagagagggaggatatgaaaacaattcgaaaaaataatttctaggaattttagcacttttactttaaaaaaaaaaactatacaaattcaataagcttaacaaactcaaaacacaagaaacatgaagaaaactagataaaaataccctgtaatcagccaaaaccactgcaaaaaaaaatcttattaaaaaccagaggaaaaaacacatgaataaaaataagaataccagtagattccttatcacaaataatg

SEQ ID NO: 403206 - DNA, 501 bp, Homo sapiens
ctcagcagccagaggcttctcagcacttctgcgttcccatctgggtgggaactgcatggcctgtttaagcacaaggagggggagtgtggggaagggggagcagagtgagtggggaggtcagaaaggcaggcactggttcatgtagggtggttgatacagtttggatgtttgtcctctccaaatctcatactgaaatctgaccctcaatgctggaggtgggacctggtgggaggtgcttgggtgacatgggccaatccctcatgaatggcctggtgccctccctgtggtaatgaattcccatgagatctgattgttagaaagagcctaggtagctcctctctcttgctccatctgtcactgtgggacacctctgctacccttcccctcccaccaggagggtaagcttcctgaggccctgaccccaagcagatgctgctgccatgcctccggtactgcctgcagaactgtggaccaaataaacctctcttctttataaacggc

SEQ ID NO: 403207 - DNA, 4885 bp, Homo sapiens
  misc_feature (1029)..(1029): n is a, c, g, or t
  misc_feature (1237)..(1237): n is a, c, g, or t
  misc_feature (1314)..(1314): n is a, c, g, or t
  misc_feature (1323)..(1323): n is a, c, g, or t
  misc_feature (1338)..(1338): n is a, c, g, or t
  misc_feature (1342)..(1342): n is a, c, g, or t
  misc_feature (1347)..(1347): n is a, c, g, or t
  misc_feature (1374)..(1374): n is a, c, g, or t
  misc_feature (1377)..(1377): n is a, c, g, or t
  misc_feature (1848)..(1848): n is a, c, g, or t
  misc_feature (2048)..(2049): n is a, c, g, or t
  misc_feature (2052)..(2052): n is a, c, g, or t
  misc_feature (2069)..(2069): n is a, c, g, or t
  misc_feature (2481)..(2481): n is a, c, g, or t
  misc_feature (2875)..(2875): n is a, c, g, or t
  misc_feature (2916)..(2916): n is a, c, g, or t
  misc_feature (2922)..(2922): n is a, c, g, or t
  misc_feature (3126)..(3126): n is a, c, g, or t
agttgcgtgccgtggtggagcagacagagcggtcccggaagctggcggagcaggagctgattgagactagtgagcgggtgcagctgctgcattcccagtacaccagcctcatcaaccagagatcaggcggagccagacggcactgaagatgctgacaagtctgcctacctcatggggctgaactcagctgacctgctcaaggggctgtgccaccctcgggtgaaagtgggcaacgagtatgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgnatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggncagagaagctgctcagctctctggacattgatcacaaccagtacaagtttggccacaccaaggtgttcttcaaggcngggctgctngggctgctggagganatgngggangagaggctgagccgcatcatcacgcgnatncaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagangagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggnngangaagacaaggtcaacancctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggcnacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttgncccggcagctagaggaaaaggaggcgctaatctcgcagctnacccgngggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtgnaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggatgctgacctgtcccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggcggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactctg

SEQ ID NO: 403208 - DNA, 5956 bp, Homo sapiens
  misc_feature (2100)..(2100): n is a, c, g, or t
  misc_feature (2308)..(2308): n is a, c, g, or t
  misc_feature (2385)..(2385): n is a, c, g, or t
  misc_feature (2394)..(2394): n is a, c, g, or t
  misc_feature (2409)..(2409): n is a, c, g, or t
  misc_feature (2413)..(2413): n is a, c, g, or t
  misc_feature (2418)..(2418): n is a, c, g, or t
  misc_feature (2445)..(2445): n is a, c, g, or t
  misc_feature (2448)..(2448): n is a, c, g, or t
  misc_feature (2919)..(2919): n is a, c, g, or t
  misc_feature (3119)..(3120): n is a, c, g, or t
  misc_feature (3123)..(3123): n is a, c, g, or t
  misc_feature (3140)..(3140): n is a, c, g, or t
  misc_feature (3552)..(3552): n is a, c, g, or t
  misc_feature (3946)..(3946): n is a, c, g, or t
  misc_feature (3987)..(3987): n is a, c, g, or t
  misc_feature (3993)..(3993): n is a, c, g, or t
  misc_feature (4197)..(4197): n is a, c, g, or t
gaattcacagatagagagactctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtctgcctacctcatggggctgaactcagctgacctgctcaaggggctgtgccaccctcgggtgaaagtgggcaacgagtatgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgnatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggncagagaagctgctcagctctctggacattgatcacaaccagtacaagtttggccacaccaaggtgttcttcaaggcngggctgctngggctgctggagganatgngggangagaggctgagccgcatcatcacgcgnatncaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagangagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggnngangaagacaaggtcaacancctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggcnacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttgncccggcagctagaggaaaaggaggcgctaatctcgcagctnacccgngggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtgnaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggatgctgacctgtcccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggcggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgccaaactctg

SEQ ID NO: 403209 - DNA, 714 bp, Homo sapiens
agttgcgtgccgtggtggagcagacagagcggtcccggaagctggcggagcaggagctgattgagactagtgagcgggtgcagctgctgcattcccagtacaccagcctcatcaaccagagatcaggcggagccagacggcactgaagatgctgacaagtctgcctacctcatggggctgaactcagctgacctgctcaaggggctgtgccaccctcgggtgaaagtgggcaacgagtatgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaacaagagtgaaactccatctcaaaataaa

SEQ ID NO: 403210 - DNA, 450 bp, Homo sapiens
ttgaaagggaattttaaggatactacaaagtggtagtattttgtcatggtctgctgatttatttcatgtgctccagtggtttggtcaattttacaaaagacagcaacagtttaaagtgctagacttaaaaagtctgcattttctccatatgaaatcttaggtccgtatgacagccaacacctcaaacgcttcttctgaaagtaccttcttattttgtgcgtttctgtgttatacacataggtgtctgtgcttcactaattaggtagctgagggactggagggaggaaacttgtccaagaatattgagtgatgaacagcacacaccattaaagtaggtagagggagtattgcacacattctcatgaccttttttggttgaattaggggcccagaaacacttagctgagcagctctgactgtacttgccttttttcaattcaaacagtaaaa

SEQ ID NO: 403211 - DNA, 341 bp, Homo sapiens
taccagtttgtagtatagtcttctagatatttatgttggtgcaaaagtaattgcagttttgccattaaattaaaagtatattttaaatattttaaatgagaaatccacactttacactccatgttgtacctgtttttgtctaagaatatactttggatatctgcagtttactttgacatgcatccaaaagttaagatacatggaatgatgggtatatatgtgataaagcaaataaagcggaatgttaaagttttaaactaggtgatgggtgtacaggcaaaattctttaaactttgctgtgtatattacattgtacataataaaatggtggcaaatctatg

SEQ ID NO: 403212 - DNA, 563 bp, Homo sapiens
cctccccaactcccaccacctactcaagaaaggtatctggctctgcacctccttatttggagatgaaaatggactaagctttcaggcatcctgcctgcccttgctgcctacagccttatcactggttgcaaaaatagctttggtaatctccaaagatggatgctccaaccccacaaccttggggcttcccaccacttggactcttaatttctcatgaaccctacagaatacagctaatacctgagctgtttctcttcaaccagccaaggtattcctgtcttaactaggattaaaattcttatccatgctttatttgtcctagacatagctaatggtagaaaataaatgtataatttcagtcttccattaaaaataaatattgggccaggcacagtggttaatgcatgtaatcccagcactttgggaggccgaggtgggtggagaggaatcctctccttccacctcctggctcctgccttctgtcaccatctggccattgaaggggtcccctggtctcctgtggggggcacctgggggctgatggcgttggtccccatgatcac

SEQ ID NO: 403213 - DNA, 464 bp, Homo sapiens
ctttgcccattgggtgagacgccactcacagaagggaaatggcttcctaaatctaatcattgccccttcaagcactaacaacccgtgcccaggagctgatggctaatgaattattgagctggaaagggagaagaggtagaaccaaggaggaaagaaacagaaaaatgagagagcaggccgggtggggtggctctcgcctgtaatctcagcactttgggaggccaaggcgggtggatcacctgaggtcaggagttcaagcccagccagcccaacatggcgaaaccccgtctctattaaaaaatacaaaaaaatttagctgggcctagtggtgggcgcctgtaatcccagctactccggaggctgaggcaggagaatcgcttgaatctgggaggcagaggttgcagtgagcagagatcgcaccactgcactccagcctgggcaacagagcgagactccgtctcaaa

SEQ ID NO: 403214 - DNA, 443 bp, Homo sapiens
agaccctgtctcaaaaacaaaaacaaaaacaaaaacaaaaacaccacacagctatgaatagtttatcttaaatatttttcagaagtgtaaaattttcataaaacttagcccatttatacctttcttctattgtctttagggtcttcatgtttttaagagaccattttaaggatcttgaacctgatactgctgtctattaatgaaataaactcagggtctcactttgtccccagactggagtgcattgccagtgcatattttgttctgagcattcactgtaaatttttggtagtattccccataggaatctcaaacttcaggagagcagctttcagaataacaggagagctcaaaatatcagtcaagtcttttatttttcttttcttttcgtatcctttattttatctattcttggagtagatcaagtgcccaccccacagctc

SEQ ID NO: 403215 - DNA, 471 bp, Homo sapiens
cacaaagagttgccaacatacccagtgaaatagaaaatagttcctattttgttcttcagcaataattgttaatacagatttgtacaatcaggatattaagcatttggggacactagttgcaactttcaccagagcccacatttgctcacagaggagccattcggctgcctgtatcaaaaggatcagtggagtagggcagccagctgaccccattactcacaactttcactatctcaggtttgaggcaggagcgtgccaaccccatttacaatgctatctaatagggaaaatttaaatctaaagttgtcatcataccaagttaattaaattcatattaaatgtcaatcaaagccaggcaccattgctcatgcctataatcccagcattttcagaggccaaggaaggagaattacttaaggccaggagttcaagattagcctaggcaacatagtgagaccctgtctctataaa

SEQ ID NO: 403216 - DNA, 101 bp, Homo sapiens
gcatttttttccattctgtgatggcaaaagaaaatctaaccaaccccaggattttcttagtcacttcaagtttgaatgcagccccttcagaattgctcctc

SEQ ID NO: 403217 - DNA, 374 bp, Homo sapiens
aagcccacagtcacaaacttgtgcaggaatgggggtaccgggaagcagcccggtgttccaagccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttgtcagcgaaggatgcgcccggcgccccccggcggccgc

SEQ ID NO: 403218 - DNA, 429 bp, Homo sapiens
ggactacaggcgcctgccaccacgcctggctaattttttgtattcttagtagagacggggtttcactgtgttagccaggatggtctcgatctcctgacctcgtgatccacccgcctctgcctcccaaagtgctgggattacaggcgtgccaccagcgcccggccaactccattcttttgagcaagatacttaacgtgggcgacaatgttctaatgtcctagatggagtctctggctaaatttctgtgtcttctccaaacccagtgcatgaagctcttcttgaaaccccagggcagaggctgtgtgtgcccccattagcgctgcaactccttaagggaagatatactgagtctccactggaagtgagatctgagacttaatcaggtgatgtgatgcctgaaatttggagttagaagaggcaggtgaccac

SEQ ID NO: 403219 - DNA, 324 bp, Homo sapiens
acctactaaaaatcagtaattgagaaaaattttaattggtatccaattttctgatgtaccaaaagaaaatagtgtgaaatcatatacgagtttctggtattgctgagccaaaaacagaaagaggaacagaaagttaagcccacaggaattattgctaaccctatgtttttctgtgtttgaggttataattcttttctttcacagcttttgaaaagtaatagaaacactgttctttccccctcaaaaaaattaggcaaaaacgacattcctgttgagttaaattttccaattacaaataaaatgtgctttgatatatttcttcta

SEQ ID NO: 403220 - DNA, 492 bp, Homo sapiens
ggatttcatgggtcattatctaccatatatatgcacatatgtgtgtctctgtatatgtacacacacagaaacacacgcacattctctctgttgacttacagattgcttactaaagctgcgtaagttgttgacgttaactactttacaaaaatctttagaaatgtgtttctaaaaaattaaaagctgggtgtggtgtgtctgacagcctgtattcccagcactttgcgaggttgagacaggtggatcgcttgagcccaggagttcaagaccaacctgggcaacatggcaaaatcttgtctctacaaaaagtacaaaaattagtccggtgtgtttgcgtgtgctctcggtcccaactactttgaaggctggggtgggaggtttgattgagcctaagaggtcaaggctgcagtgagctgagatcatgccaccacattccaatctgggtgacagagcaagactctgtctcaaaaataaaaaaaaaataataaatta

SEQ ID NO: 403221 - DNA, 342 bp, Homo sapiens
gagcattagattaggacaaacagctaatgcatgcggggcttaaaacctagatgacgggttgatatgtacagcaaaccaccatggcacatgtatacctatgtaacaaacctgcactttctgcacatgtatcctagaacttaaaatttaaaaaataaataatttttgctttctcattaaagcagatttcacaattgctatactttacagttatttggtaaaattggagtttatgcttcaaaaatatggcccaacaagtaccaagggcattcttctgctcatcttatcaagatttactgaacacttactgtgccatgcatgccatgtgcactagatgcagcaaaa

SEQ ID NO: 403222 - DNA, 470 bp, Homo sapiens
cttgattgctgttggtggacactgtctctctgtagtaacactatgatatccacaaaagcttttattatctgccagcaacttccctttgttagaaggagagggaaaaaatgattcccaactaggattctgcccttttcactactgctgtcactttctagcccattaatcctccaaaagcatatgaagcctccattatcaaacagttatccaataatcttaaatggttgtgtccacagacattagcagaatttctgcagtgttgcacatgtatgtgtacgtgtgtgccgtgttgtgtgtgccatgagggcaacagatccatcagtcctctgtgtccccagtggctcccagcacagcactggagagtattttgaatacttttttttcttctgttttacttcctgagctttctattaaactacccacattaatatagttattacatacaatgaatagcatataaatatttttct

SEQ ID NO: 403223 - DNA, 413 bp, Homo sapiens
tttcagttatctggctttagtaaaatcaccttcaaaaagaatggaggtgaatagagataaaacatttttttgtagagtatatgggctgacatttaagtgagttctttagtaagagtcttaacatgtcatacatgagaagacaagaattttgaaagaccgattggtagattatgttaagacccacaaagcaaagtatgtttctttggtcccatgtttgtgtaggtctttgtgtctcacagccaggctctctgtgtagtgaagttagatgccctgctcaggatgtgttgaattgggcaaaaatccgaacccacatgaaagaacagagagctattcttacaaaacagcaggtggattgtattcaggaggagttccaggagttgctgcaggaagagagaaattccaggaggaaagga

SEQ ID NO: 403224 - DNA, 536 bp, Homo sapiens
ggttttgccttttctttccacctctaaatatcatagggcctcaaaactcaatcctggtacctctcctgtccttcactgcgttctcttcctaggtgaccccatgcagtcttggggctctaaatttgacctctagaatataaattgctcctcaatttcagactcagacttacttgtggacatgcatctccacttaggtgtctaatagacaaataaaactcagtaggtttcatgagtttcaactgaactctcgaacttgcccctctccaaaacagctctacttgtagccttccacattgcagataatgacaccatccagatatgtgccagtaaagctttaacatctgtcagggttgaggagggtagagaagctctagattgtagtgtttgcagatttccttcatgtaaataatgctaatatttatcaaagtcaagctgtcaacctgaggtcattgaaccagagtcgggaagaatgctctggagggcagttgtgccctggctcctgccacacttcagcactatttacccagcggttcagc

SEQ ID NO: 403225 - DNA, 267 bp, Homo sapiens
ggtgaggcaataaacacagatttctccttttattggttgtttgcgttagaaggaagtgatgttcatgtgtaacttcaaactctgttccctgatgtcaacctctgccctactcttcattaagcagagctgaaattacagatttatttttcctcccttacctctcctttcctaaggggaaatactctatacagttccctttctgttaccaagcatgattagaaatgcaaggtttgactgatgaagtcatttaacctcttggattcatag

SEQ ID NO: 403226 - DNA, 436 bp, Homo sapiens
agataaaggtcttcaaggcatgccttgaatgatctgcatccgtcttgctaagccttgggctcctactcaagcttcaggctgttttccactcctggctggggccacactcctgtccccacccactcaacctgctgctcagaatccctctctcccctgcaactcctcctcctaggacttctctttccctaacactgggtcactgaatcttgctctcagtgaattcatgttccttgccccatatccaacctccactccatccccatttcccctctactattctacctttccttctattatcaaaggaatatcgctttctaacatactaattcatttactttttatggcggtggtttactgtcatctctctccgcctccgcaggtccccattcactggaagtggagcttgttggagggatctctgtctagggctccagct

SEQ ID NO: 403227 - DNA, 232 bp, Homo sapiens
tgcccgcgttgacagcaccctgagtccccatgaacacgcgaaaaggtttctagctcctatcaatgccgttcggaagcaaagcaagtgttcacgactcgccttgatctggggccctgtccagggtgggaaggccccagaagcaggcgccaggacagaaatgagcctttgcccttcccaatccacgcagcgtcccgcccaggcccgggttcccggcagccaggccccctccccg

SEQ ID NO: 403228 - DNA, 163 bp, Homo sapiens
ctcagcaaattcaaatcttgctttttgaaactttcagaaactatttttctttcaaatgtttttgatatacagttgggtgaatctgcagatgcagaaactgcagataggaagggctggctgtcctttttcataagactgatctgagaatgctcccacagacaag

SEQ ID NO: 403229 - DNA, 105 bp, Homo sapiens
gggctctatttatgggactggggtcccaggacaggctgcacacagatcaactgcccaaggagagacaactggctaatggtaagctgggcctgggctaaaggaggc

SEQ ID NO: 403230 - DNA, 282 bp, Homo sapiens
agtgagaagtgcctagctgaggaaactgaggatcagggaggtggaggagccatggtcacacaggcagtgagtggaagagacggaatgtgaacccagggtccttcatatgctgacaggagaaatgaaggaaggggatgatttctgcacaggctagatttcatctattgccccagaggggtccagctgggactccaacctcaccactccttccagaaactgtccctgctggctgaaaggaggatggaggtggtagccctcattccttatgctgggactcaggcc

SEQ ID NO: 403231 - DNA, 435 bp, Homo sapiens
gtacaagtttttatgtgggtgtgtataggtagatgcctatcttaccgatatatggaatggagttatagtaacttgtagcgtctttctctgctgactccaactgtatgtcagttctgagtctgttttggttgattattttctttacgtgtcatgcttttctgcttcgttgtatgcctggcagtctttgactggatgctgaattttacttcatgggtgttaaatattttcgtattgttataaaccttaaactttcagagacgtagttaagttacttaaacagtctgatactttcaggtcttgcttttatgatttgttaggcagacctggaccaatgcttagttgagggctaatttttctttttctttttgagacggaatctcgctctccctccaggctgaagtgcagtggtgtgatctcagctcactgcaacctctg

SEQ ID NO: 403232 - DNA, 412 bp, Homo sapiens
caagctgacaactgatgccagtagctcacagtaaagccttaatttgtctagactcagaaagtgacaagggtttaagctgtctagtccaatttctgttctgtactggattcatgctacgtggctccatgtccttccaatggcagagaggtcattactccatgaaacaaccacacctaccctggggagctctgagtgatgcaacattctcctctttctttgtactgagctgaagtctgtctgtctcccttgaggtcacaaaaggcaacttagcctcctatccctggagtcagtcctgcctccatggaaagacactgagcagtctttccccagtctctgtgcatttggggtaaatgcgcttctgtttatctgtgttccttgaagtgtgatacctgggaataaacccccaaacctt

SEQ ID NO: 403233 - DNA, 342 bp, Homo sapiens
acattggaaaataggattcaatcttttcatttgcatggatagtaactggtgtcactcctgctttctagttaaggcctgcaaacttggtaatcattaatcattaaatactcaaaggcatacaggagcctagacaggtgacataaatgtataaactggggttggatataaggcaataaaaagtagtgaggcctactggaatgcacgacccacctaaaggcattctgtgtgtgtgtgtgtgtgtgtgtgtgtgtgtgtagtacttgaataaatttttcttaaaatacccaataaatcaactgaaaaaaaatttgtgccaggcaaacaaaactcagctgcagcact

SEQ ID NO: 403234 - DNA, 170 bp, Homo sapiens
gtcttgggtgtgtggaacagggctgggtgtgtgtgtcttctgggtgatgatctctgatgtaggtccagtctgggcatctaacagtttattcatctgttgtctcatagagcatctttgatcagagagaaagtgaatttctttgggaaataatccaccttgtattgtaaagg

SEQ ID NO: 403235 - DNA, 645 bp, Homo sapiens
atgatggttttattataggaagcttttatatgaagtctaattcaaacttttatgttagctatttggttgcttgggaagttacattgtaatttgatgcaggattttatactactggaaaggtaatatagtggctggttgctgccttaaagttgcaagttgagtattcacattttgtaacgaatgtacataaaattaaatggctgtttctaaaacatagggaaatgccttgaactatttttaatcttttgtactactactatttttttctaacaaatatctttgtttgctttcctttatttgttcatcccaaaggcaacagtttttatgtaaatgtagtaataattttaacatttaagtaactccttcaaattactatattgaacatttcttgaatactttccctgtttaatgcaaggtattgctaaaggtgctttcatgcacggaaagagtttatactctaaaatacatgaggcttattatactaaattacattacttaggcaattttaaaattatatcacagaaattgttcattttattcccccaaaagcctcatggaaaatgcctacctctgttatgtcaaaagtttgataattttgtgatcatttgaaagatggtttaatactctccccctcaaaaaaaaaaa

SEQ ID NO: 403236 - DNA, 579 bp, Homo sapiens
tctttgtcctttttaacttggctattaggaaatttaatattatgatatatgtggcttaatttttttattttgttttttgagatggagtctcgctctgtcaccctggccggagtgcagtggcacaatcttggctcactgcaagctccacctcccggcttcacgccattcttctgcctcagcctcccgagtagctgagactacaggcgcacgccaccacacccggctcattttttgtatttttagtagagatggtgtttcaccatgttagccaggatggtctcgatctcctgacctcatgatatgcccaccttggcctcccaaagtgctgggattacaggcatgagccaccgcgcccggccgtgtcttaaatttttattggatgataactaaactattaaatgaatgagagaaagtggaagagataccttctattttgtttgcacattagttttgtttggaatatctttgtaagtgctgcttagtctatatcctgattacctcttatgcaaaatgtataatttccaactgctgtaaatgtactgtgctactctttcttttccacttgtcctagtctttttt

SEQ ID NO: 403237 - DNA, 488 bp, Homo sapiens
tgcctggctgtgcacagtgtggccagaccccatgctcacacaccccttgctgctgcacatctggttcacccatggcaggcatggaatccaggccagtagcacaagcagagcacagcctgccaggccaagtgggtggaacaaacacagtgagcccgagcaacacttgggcaaaggcaccactggccacagaggtttccagctggaaaagtgacatcccaagaatcccatgacactactataaactggcacagctttgtactatgctgctcagatagaactggtcagacaaggccaatgggtcagaggtagttctctctgctagaggtgagtctcgctgaagagccatagcttagaacctagggctgggagttttgtgctataagaaaattggataggaatagaagggatgaattctaattttttggcaagctgtatatgtggtgttcagaatccaaaataaacatcacctgatatccacaggatacaca

SEQ ID NO: 403238 - DNA, 580 bp, Homo sapiens
ttttacagtggtgctggacatgcagtcccactcactagacattttggagcattacgtggaaatgcccatccagcggttggagaggtagggtaggatctgaagatctcaagcctcggaagcacagatttaggagtcactgacttagaggtggtagtttcaagtgacgtgatggttaagttcaccaagagaaaaagtttagaaagaaaaagagctgagccttctgccctattttttagaagagggtttctgagagcctgggtattcaaatgataagatgggtgtgtggtgcagggacaagacttcagtcagaggacccagggtctctgctttagcaccatcttgctgtgtgacgttgggcagctgaccttactatcagtgcctcagtttcctcccctgtaaccagggacaataatgccagccctctctccctcccaaaattattgcatggatcaaaagggagaatgcacaagaaagtgctttgtaaaccactcaaaagactcatcaaatgtaagggattattataattgcagtgggagatgcaggaggccaataaaatggatttggttgcagtaagaaaaag

SEQ ID NO: 403239 - DNA, 536 bp, Homo sapiens
tgagtgtgagaggtctaggagacatctggagcgtgttgacccccgcaagtctggtgagtcctccagcttagcctgtcccggcccctcacagctgtcccttctagaatcacagccctgtgattcatccccacctgggccttgtttcctgaaccccacatctgaccgctggcccgagggagaatgccgtcggcccctgctctgaaagccctgaaagcccatgcctgcgtgcacacacgcgtgcacacacacacacaccctcttgatttgatttcctgtggcctgggtatgtgcccactcccattggcacacctagacccacctgctggcccagatccccatgcttggtctgcactgagacacttgcatttccacgctgggaacctcacccaggaaggctagaggatctggaaccctcacccctcaccactctctggccactgtgctaggtgtccctgacatgaaggaggcagtgacagttacgggcccagctctgggccaccaccaggtctggcgagtgtcattgtcaggatgatgct

SEQ ID NO: 403240 - DNA, 363 bp, Homo sapiens
cccatcttgcagagcccaacctagggagcagggaacagagagctgccccgcggcaccatctgtttctgccagcatctatgttgggccccgccggttacatctgttgagaagaacagtgtacttgatgagttgttggaaagaaatgtttagtctcccccatcatctctgttagccattacgaggctgctgggctcacgtgggtgtatctatgtgtgcttcctctcaggcctcatctgtatcaattggaaatcagtcactgggagttagttgcagtcagcagggacccaaggcatttcccagtgacatcaattcgtcttctcttgcagaaattcaggaaacaattaaaattctgatgcgttccag

SEQ ID NO: 403241 - DNA, 259 bp, Homo sapiens
aagacacaccacctgtcctcagagaacagtaatgggtacatttggtcaacaaataactcaaagtctgaagtactaatgtggttatttatttatttatttatttatttatgtagagatggagccttcgctgccttcgccaggctggagtgaagtggagctatgattcctcctctgcacttcagccccatcctggatgatagagcaagaccctgtccatctgtccatccgtccatccatccatccatccatccatccatcc

SEQ ID NO: 403242 - DNA, 1159 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaa

SEQ ID NO: 403243 - DNA, 569 bp, Homo sapiens
atctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaa

SEQ ID NO: 403244 - DNA, 1311 bp, Homo sapiens
gaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggatgagggggatgctacagggatctggcggatagaggccagggatgctgctgaacatctgcaatgcataggacagcccacccccacccccaggggcggggtaaataatgatccagcccaagtgtcactggtgctgacgttgagtaaccctatcttaagctgtactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaaagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaa

SEQ ID NO: 403245 - DNA, 484 bp, Homo sapiens
caaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaa

SEQ ID NO: 403246 - DNA, 1383 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403247 - DNA, 1884 bp, Homo sapiens
  misc_feature (1414)..(1414): n is a, c, g, or t
  misc_feature (1419)..(1419): n is a, c, g, or t
  misc_feature (1444)..(1444): n is a, c, g, or t
  misc_feature (1484)..(1484): n is a, c, g, or t
  misc_feature (1486)..(1486): n is a, c, g, or t
  misc_feature (1510)..(1510): n is a, c, g, or t
  misc_feature (1513)..(1513): n is a, c, g, or t
  misc_feature (1528)..(1529): n is a, c, g, or t
  misc_feature (1553)..(1553): n is a, c, g, or t
  misc_feature (1562)..(1562): n is a, c, g, or t
  misc_feature (1565)..(1565): n is a, c, g, or t
  misc_feature (1570)..(1570): n is a, c, g, or t
  misc_feature (1573)..(1574): n is a, c, g, or t
  misc_feature (1618)..(1618): n is a, c, g, or t
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaaaaaaaaaaaaaaaaaaaaaaacccgggggcnccatnggcggggggggggaaaagggggagnggaaggggcccgtggggcacagggtggttcccggaccacngngtttcttgtggcacacaggggggnganaactcggggcggggnncccccataataggaggggggcggntaataaaanttngcagnaannggccggggtaaaggcgggggattaaacgggactccgcgcaaacncgagcaacaagacagacaggaacagggcaaaggagaaaccaaggacaacgaggcaacacaaaccgccgagaaaaacaagagcagcaggaacgagacacgacaacactcaacgaaaacaagaacacgacacccagaccgcccacagagaaaccgaaacgccgcgacgagcagcaccatcagcacccacccccgcacagacccaccgggcacgccccacaaacccccgatcggaagccagcacaccccaccctccagcccccccacac

SEQ ID NO: 403248 - DNA, 1321 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403249 - DNA, 1466 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtgggctgggactagaatgaggtgagcaaggcacttgccctcgggcgcaatatttaagaaggtgccataaaagtgtagtaatcaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403250 - DNA, 1423 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtgagtcctggacaatgggccctggagaaagcctaggaaggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403251 - DNA, 1385 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgcttttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403252 - DNA, 1088 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaa

SEQ ID NO: 403253 - DNA, 1148 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgcttttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcaaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagc

SEQ ID NO: 403254 - DNA, 1029 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgcaggggtgcaggcagaagcggggagctatgcccagtcagtgccagcccctc

SEQ ID NO: 403255 - DNA, 1730 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaa

SEQ ID NO: 403256 - DNA, 1479 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgcttttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403257 - DNA, 1660 bp, Homo sapiens
  misc_feature (1190)..(1190): n is a, c, g, or t
  misc_feature (1195)..(1195): n is a, c, g, or t
  misc_feature (1220)..(1220): n is a, c, g, or t
  misc_feature (1260)..(1260): n is a, c, g, or t
  misc_feature (1262)..(1262): n is a, c, g, or t
  misc_feature (1286)..(1286): n is a, c, g, or t
  misc_feature (1289)..(1289): n is a, c, g, or t
  misc_feature (1304)..(1305): n is a, c, g, or t
  misc_feature (1329)..(1329): n is a, c, g, or t
  misc_feature (1338)..(1338): n is a, c, g, or t
  misc_feature (1341)..(1341): n is a, c, g, or t
  misc_feature (1346)..(1346): n is a, c, g, or t
  misc_feature (1349)..(1350): n is a, c, g, or t
  misc_feature (1394)..(1394): n is a, c, g, or t
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaaaaaaaaaaaaaaaaaaaaaaacccgggggcnccatnggcggggggggggaaaagggggagnggaaggggcccgtggggcacagggtggttcccggaccacngngtttcttgtggcacacaggggggnganaactcggggcggggnncccccataataggaggggggcggntaataaaanttngcagnaannggccggggtaaaggcgggggattaaacgggactccgcgcaaacncgagcaacaagacagacaggaacagggcaaaggagaaaccaaggacaacgaggcaacacaaaccgccgagaaaaacaagagcagcaggaacgagacacgacaacactcaacgaaaacaagaacacgacacccagaccgcccacagagaaaccgaaacgccgcgacgagcagcaccatcagcacccacccccgcacagacccaccgggcacgccccacaaacccccgatcggaagccagcacaccccaccctccagcccccccacac

SEQ ID NO: 403258 - DNA, 1289 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403259 - DNA, 1394 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtgagtcctggacaatgggccctggagaaagcctaggaaggtccccaggatcggctgagagccctggtggtgatccccatcatcttcgggatcctgtttgccatcctcttggtgctggtctttatcagccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403260 - DNA, 1357 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaaa

SEQ ID NO: 403261 - DNA, 1091 bp, Homo sapiens
ggctggggcaggggagtcagcagaggcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtgggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaa

SEQ ID NO: 403262 - DNA, 647 bp, Homo sapiens
atcagcccaccaccatcggccagcattccaggcacctacctggaaactgagaaaagtttggtagcagataaaatcctcctaaaaaacaagcctgaaaatccgaagtgcgtcctggacttaggtgactgagtgttctctgtccttgtctggtgtgcctgagagcccagaggtgagaaaggtgagaaagaagagaagtccagggaaagaatgggagagaacagagccgcttggaggagcaggggcagctccaccactctgcttacggtgtgtaggggaccgtccccctgcagaccctggccttaggacctctgactctcattcggcccagcctgctctttaaaaatgtaggagagattgccatcaaaactcatcagcaaaaaaggttagcagttcttaacagttttaccttgaactctcctgcagtctccattccttctctgatgatgctagggacgggagaggtgctaggagtctgaggacggtgtggggcgtctcatttgctaacctgacttgtttgagctacagggctgcacggagttgagactctcatgctcacatgttgcttcggtcttactttagcatttctctgcaaatttaaataaggctgtatttgtgtgtgtgtgtgtgtgtgtgtgtgtgtcttgctt

SEQ ID NO: 403263 - DNA, 370 bp, Homo sapiens
gtggggacccggtgaagtagattcctctctgagactcttccttgctttttattatgtggggactgagatgatccccagtgcccgttagatctgacatatctgaccctgactgagacctcagtgatcggggactgtagttcacatgcagagcccccatgtgcctgaatgccttgctcctgaaggtccattctaggccctgctacaggagtcggccactgccgtggcatgtggatggcatcaggagctctgctggaaccagggccggagcccttgtttcttgctgtccttgcaattggaggtcagagcaggagaggtgatttgccctggaccacaaagaatggctggggttggtttaattggagaggatctt

SEQ ID NO: 403264 - DNA, 368 bp, Homo sapiens
attgctgttatggaagccccccatttgctggggcttaaggctagagacagaccccaggctgagcgtgggagtcctgcggtttctagctgaggttgagggggctgcagggtgcttggcacggagcagcattacaatgcctgccccatcccggaagccttagtcaattaagcagctctgacctgaagccctgtgggaagcagcttgttctaaatcaccgctttttttttttttttgagaaggagtccagcctgggtgacagagggagactccgtctcaaaaaaaaaaagaaagaaagaaatacataaagtacctagcaccgtgtctggatattgttaacattccttatggagtcaggacaagcagttgaa

SEQ ID NO: 403265 - DNA, 250 bp, Homo sapiens
tatcagccggcccagtacaacagctcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403266 - DNA, 7579 bp, Homo sapiens
  misc_feature (14)..(14): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatctcgcgcgcgcctctgctgctgctacctccctgtgccctgatgcctcgcccttaccctgtgctgggtgtgctgtgctgtgctgctgttcctccatgctgtgctgtgcatgctgtgctgctctgcatgctgccctggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403267 - DNA, 6763 bp, Homo sapiens
cggccgccgccggccgggccccaagcccccgagggcgccagggcgggatcgcgaccggtgcaacttctagccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403268 - DNA, 7283 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403269 - DNA, 7353 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgta

SEQ ID NO: 403270 - DNA, 2940 bp, Homo sapiens
tgtggtgggcgcgggcatataccctgtcaaaatcaaactcgagccactacttcgtaatcttggctccctcctcaatctcgtatgaaacatggaaccagtcacagctatcaatacccctggaatccactaaagtcgatcttcaagagtaagcacttcatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403271 - DNA, 898 bp, Homo sapiens
ggacgtgtgtacatatgtaaatgagaaatagagacgtgtcaacagatgcattcatttctcttggaatagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgta

SEQ ID NO: 403272 - DNA, 803 bp, Homo sapiens
  misc_feature (7)..(7): n is a, c, g, or t
cccctanttttagaagttcaatagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403273 - DNA, 5134 bp, Homo sapiens
  misc_feature (14)..(14): n is a, c, g, or t
  misc_feature (3145)..(3145): n is a, c, g, or t
  misc_feature (4158)..(4158): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatctcgcgcgcgcctctgctgctgctacctccctgtgccctgatgcctcgcccttaccctgtgctgggtgtgctgtgctgtgctgctgttcctccatgctgtgctgtgcatgctgtgctgctctgcatgctgccctggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccggtctgttcctctttccagatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagaggtgagtgcagcagtgggagcctgggaggtgggaactgggacacctgggcttgaagacatgggccgtgggtacggctttggaaggggtgtggcttggactccagcacacttggacaaagaggcaggggcttaggggtcaggtgctcctgggtttgagacctggttctgctgtttcccaactgaaagacctcgagccagtcaccctgcctcctagggctgcttgagggacttgaggaggtgtccgtgaagtgcttggccctgggctggcatgtgccgccactcagcaagcagcagttcctcttactgtagtgactcttgtcttggctcagccactaactgggtgacctgggtttagttcctcctgcccacatgagagcttccccaactcctctccaagaaagagagctgagacaaaatgcttccagtctataagggctgacccgtccgggaagtgactggaaggcaggcagcgtgtttccagtctgtaaggattgacctgttggggaagtgactggaaggcagagagcgtgtttccaatctataaggactgacccgttggggaagtgactggaaggccggcagctgtttccagtctataaggactgacccgtcagggaagtgactggaaggcagacagcgtgtttcttagctcttgtttccatccacacttggtcactgtataggaagtggcactgcctcttgggctgcacagccagctcagccaaggtgttggggaagatttggggaagtaaaacccacacctcctgccctctgggaagtgaggttttagcaggaaagaaaagtttttagcagagactcaccagggaatgaagcatagcagactgcacagaactcaatatgagtcagagaaggcaggcttcctggagggtgtgtcacaagtaaatcctcagaaaatgatgctggcagcagctggcccatctgggtacccaggtaaggatttagtttacctgcagaagacgtagggacgtggctctgcagatgcccctcgtgaagccctggttgctccccacgaccaagcccctttttgagcagggtgtgcccagctctctgcctgcctccctcccagcttgcatgcccactctcagagcagttttctcctcctagctcctctcagctctgtggccttcaccttgggttcacagcggctttagattccaaagaccttaagttccttgaagatctgcacatttcccctcagtatccaccttaggatgggcggggaggcttggcaacaagtggaggtattctgagttcaggaggggagagagagngggggggtcaggggcttcctcatgcatccaagaagctggatcaagccccaaccctccacctggtggacactagttcagggaggggccagagaaggaccattggctcctgggtcctgagtttgggggagcctcaagctattggcacctctcctggcactcaggccccatgcagtttctaggccttttctcagccaccctgtgctcaaaatcccagtgtcccactggctgtgctgggggtgcatctgttagcccacgccaaaggaggcaatctcggatgaggcttcagcagaattcctggtcattggtgtcacccctgcacctgcacctgtgccatgcttatggctcttgcctgcctaaagagagcacaccaaaggctctccatatttttactaaattaatcatccttttcatagagtgctgctgctacccagctacagcactgggtggtcacagcctatgcggcctgatcctgtctggaagactggccttccttccccttgccatggcttgttcatacaatatttgaattgttggagccttaggacaggggttgggtcatctggtcccacagaggactctcttctctagcttggtgggcaggtaggcaccagctacgtcttctatacctcctgtggtgggtgcctcactgtcacccagagcagccaccatgttgcaacaacgtgagttgtagattcttccacactgacactttctgacatttatccctaagtccatcattcgtttgttgagcaagtattaagggtattttcccaggcactggggcacagccaccaacaggacctctgggcaagagagacactcagatggggaagaagaaaccactgactcacaggatgtcatgtggccgtgagggtcacctgattttccagacagggaaggtggctggagggtggtgctctctcctcttctctaaattgtctgtcccgggagaagttgtcttgttccttcaccaacctggctctcccacctcctgcacaggtggcaggttgtcnatggcccagaactgaacactaggtgtgtgttctgctctgaggggagtacgaggacaatgccacccaagttcagccttggaatgcaggggcacagggggctcctttctggaattgcatcctgttgactgtgttcctctgtcacattggggtacacattggggagcacagccctaacccaggcaccaggagagacacaaaggtcgggggagttagaatcaggcccctcataatggtgtgagcaagaggctctgaaagtgtccctggagttcaggggcacatgtgctccaggaagaacggcctcaaggggaggtggcctatgatctggacaggcagaacaaaatgcccctggatgtcaggacgagaaggggcccaaagcattatctggttttgtgggtgggaaacagcaggagcaaatgaggagaggcgggccccatcccgttgttcaggtgacctggctatgtgacgttggcaacattgaacgtgttcccctctcctttctctcccaccacagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaaggtgagtcccagcctcgccaccacccacggggccccttccctcctaaccacctcactcccctaactccaccgggatcactctgaccctgcgtgtgtttgccccaaggacagcgaggggtgggtgatttctgaacgtccccatgtgttcagggcgaagttcggtggccagaatgtcagagtggcttttctcagttcctattctcattcgtctcggatgatggtttttttttctccttttcttattcacggcactcacaaaataataaaggaaatatattttatt

SEQ ID NO: 403274 - DNA, 2129 bp, Homo sapiens
  misc_feature (14)..(14): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatctcgcgcgcgcctctgctgctgctacctccctgtgccctgatgcctcgcccttaccctgtgctgggtgtgctgtgctgtgctgctgttcctccatgctgtgctgtgcatgctgtgctgctctgcatgctgccctggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccggtaggtgtccgtgggggactctgcgatgtcactgggaggtggggaggggaactgactataaaccatgcctgtttgctgcccctgccttctggtgcctccatttgtctaggtgtagtgcgaacccctgaggaagagcaactcatccaccaggctctgggacccacagttggggctgtcctcgtgcctctcccagggagtatacttgcctcaggggtactgcagggccagagaggctcccgaggcacaccaaacccagcagtaggcactgtgctacaggcaggaccagcatcagctcactccatcaccacggtgaccccttggcataagcactgtgagctccccattttacacatgaggaaactgaggctcacaaacacagaggagatttcccaaggccacacagctggaaggcagcagagcagggatttaagcctaggcctgtacttcagagtcagcattcttaacctttatactccactacgttcattcattccccaaaaattgtttaaaatgaaacacaaaagtcgaaacaaaatgaatcagtacactcagggttccgtattgcaactttgtcatcacctgcggtctcctgaccttgcagtaagcaggggccatggagagtgccaagcagcattctgtctgggagggctttgagcactttaaagatacagttttattttacatttcccaccatcctcataacctggcttaggccacaggcaccctgctagctttaagccggacagacctgtcacttgctaagtgtgtggtctctgagcctcagctgatctttctgggaaggcaggaatggtaaggagactcctgacttcaggggtcattgtaagtgctagaaatacataaagtgcaggccgggcgcggtggctcacgcctgtaatcccagcactttgggaggccgaggcgagcagatcacgaggtcaggagatcgagaccatcctggctaacacggtgaaaccccgtctctactaaaaatacaaaaaaaattagccgggtgtggtggcgggcgcctgtagtcccagctactcaggaggttgaggcaggagaatggcgtgaacccaggaggcggggcttgcagtgaaccgagatcgcgccactgcactccagcctgggtgacagagggagactccgtctcaaaaaaaaaaagaaagaaagaaatacataaagtacctagcaccgtgtctggatattgttaacattccttatggagtcaggacaagcagttgaa

SEQ ID NO: 403275 - DNA, 416 bp, Homo sapiens
acacagaacaaggatataaaccagtatggaccggtaagggttcccactaatcctggtccagccttgcccagccagccaggcagacagccctgggaaaccagagttgggatgtcagtgcttatggggccatgtgtgctgggagagctgactgcattagggtgcatttgggctttcatggaagcatgtggaggtctgtgtgtttagaatggcgcatgtctagaatggggcgtgtcagtgtgcttgggtgtggtggggtgtatgggtgctggtgtttgttctgtgtgttggtggctcatgtacaactgcatatggggaaaaggttctacatggctctctgggcccccaactcaccaaggagtgggctcaatgtctaaaaatagtcttgtgaccggtctgtctcctggattgcctctgag

SEQ ID NO: 403276 - DNA, 252 bp, Homo sapiens
acgttcagcctcgtaccgggtggccacgtttcgggggttgtgacttccctggttgtgttgggtttcattttctccaggcatcatcgccgtgcctcctcacctcacctctcttctctcccgctctctcctcctccacagatgccacacgctggcagctctgaccagccccacccctccatacaacaaggtttgcacgtaccacaccccagcagccagtcaggcctccattacatcacagtggggctcctcctc

SEQ ID NO: 403277 - DNA, 338 bp, Homo sapiens
ctgccgcccaggcccgctccttatcaccggtacactcagaatagttcatccaccctccatttttttcctcctccctgttgtcctgcctccactttgttctttctccctttcccctcttcatttatccctcttcctctccacactgcctcgggtagcaccttaggtgacaaccacttctctgcccacaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgct

SEQ ID NO: 403278 - DNA, 7543 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403279 - DNA, 7259 bp, Homo sapiens
tctagagatccccgcgcaagaggaacggcggcaagaggaggaacggcggaaagagtaacggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403280 - DNA, 7358 bp, Homo sapiens
atcgtgccggagatcgcgccattgcactccagcctaggtgacaagagcaaaactccatctcaaaaaaaagaaaagagaagaaatgtgtgcacctgcatgtgcagttccttatcccctggtgggcatgcctgcccagtgctcacatgtgccacacatggaaagcacccagaagcatttcctgccctcagcccagtggggtaccccaggtgcagccccacagggcccagcaaaggactctggaacctgccagtgttgtggccagagggcagttgggaggctgctcaaggttggcaggcctggcgtgatccagtgacaacctctcctttctcttcgcaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaacaaaaaaat

SEQ ID NO: 403281 - DNA, 7398 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgta

SEQ ID NO: 403282 - DNA, 7438 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttctttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggatttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtaaaaaaaaaaaaaaaaacccctttccactcagggtcagagt

SEQ ID NO: 403283 - DNA, 5447 bp, Homo sapiens
  misc_feature (14)..(14): n is a, c, g, or t
  misc_feature (136)..(138): n is a, c, g, or t
  misc_feature (149)..(150): n is a, c, g, or t
  misc_feature (161)..(163): n is a, c, g, or t
  misc_feature (166)..(166): n is a, c, g, or t
cgggcgccgggaancgggcggccgggcggcaggcgggcgagcagcgatcgggcggccgagcgagcgagcaacgccggcgcagcgcggtgaccccagccccagccggcgcggagcaggagccggagccgagcggatnnnggcgccctcgnngcgctcctccnnnccngagcctgccctacccggcggtggcggcggcgcgtcctccagcggcggcagcggcgctcgcagcgcccggactcacggcagctgtgttctgatttcgtactactgctggggctgccacctcctcctccagacgctctcagcagacttgagtcctggtccttctgcagaggcctgagcaggaggaagaggaggaggcccgttggcgtcggaccaatgctgcaaggggtgtgaggagaggagccgctgtttttcactgagctgccataccccgaaagcaggatggagctggagtgaggtggaggggccgcaagctgctgaccggcgtgtgggacactggtggtttgcagatcactgaggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccacgggccttccagcggcccttcgagcagagcctgatgggctgtttgacggtggtcagtcgggtggcagcccagcaaggctttgacctggacctcggctacagactgctggctgtgtgtgctgcaaaccgagacaagttcaccccgaagtctgccgccttgttgtcctcctggtgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccaaccagcctcccggctccctttccgtggtcaccacggtttggggagtaaccaacacatcccagagccaggtccttgggaaccctatggccaatgccaacaaccccatgaatccaggcggcaaccccatggcgtcgggcatgaccaccagcaacccaggcctcaactccccacagtttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgctgacttcactcagcccgcggcagccgctgcagcagcggcagtggcagcagcagcagccacagctacagccacagccacggccactgtggcagccctgcaggagacacagaacaaggatataaaccagtatggaccgatgggtcccacccaggcgtataacagccaattcatgaaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccaacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggacgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcaggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccagatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagccaccaccaccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgtgtttctgggcctgccccagacactgcccttggctgccagcctaccctgcctgcactcctccaccatcacaatctcactcctccccttcccaaataaagatgagggtactaaagttgtcttggtataaatatacattattattaaatactttttccagtatactagcttgtcttttaagaaaggggatattcagacaaacaacaaaccagacaacagtcgccaaaaaaaacgcaacaaccgaaacctgggccacgcaacacacgcagctaaacaccgagctacaaacgccagatctcataaagagaacaagtggcaaaacgcctgaatcacgggctgagacaaaactaggcacattccacccataaagcatgggagaaaggttccacaaacaacacaaagcaaaagc

SEQ ID NO: 403284 - DNA, 885 bp, Homo sapiens
atcgtgccggagatcgcgccattgcactccagcctaggtgacaagagcaaaactccatctcaaaaaaaagaaaagagaagaaatgtgtgcacctgcatgtgcagttccttatcccctggtgggcatgcctgcccagtgctcacatgtgccacacatggaaagcacccagaagcatttcctgccctcagcccagtggggtaccccaggtgcagccccacagggcccagcaaaggactctggaacctgccagtgttgtggccagagggcagttgggaggctgctcaaggttggcaggcctggcgtgatccagtgacaacctctcctttctcttcgcaggctggacaacgttcatggctctcgggtagaacctagtgaaacggccagaatgaattctatggacaggcacatccagcagaccaatgaccgactgcagtgcatcaagcaggtgggtgtggggcaaggcacactccgagggcggggcagatggggcgggcttgcagcagcagggcatctggcgggttctggctggagacgatggcagggcctcctgaccacctacctatcgaggccgttattggcatgctggcactgaccagcctaatgctggaatcacatgcctgggtttcagtgccaatgctgccctgtccctttccacacccttcccagctgtgtgacgttgggccagtgttgtggcctctctgggctctgtttatgtgcaaggatgtagtgatgcacctggcacttccatctctctcccaccacctccctccctagaactaagctccctgcccctttgctccagtcgttctcaaaaaaaaggccaaggtaggaagattgttcgagcccagcctgggtaacatagcaagaccctgtctcagaaaaaaa

SEQ ID NO: 403285 - DNA, 245 bp, Homo sapiens
acgagttagtgggtgcagcacaccagcatggcacatgtatacatatgtaactaacctgcacatcatgcacatgtaccctaaaacttaaagtataataataaatttaaaaaatttaaaaataaaataaaaataaaaaggcaccattaacaaaaacatcagaaagtatcggttaactaggaagaacctaattaaatacgcgatctctaccgcgaaatggctagaagggcctcaggcaaacccaccag

SEQ ID NO: 403286 - DNA, 285 bp, Homo sapiens
atgtgtgtacacaggtgcctgtgcatgcgtatgtatgtgtgtgcacagacctgtgtgtgcatctgtctccatgtacctacgtctgtgtgtggcacagatgggatcctgtgggtgcatctgtacgtgtgtgtacacaggtgcctgtgcatgcatacgtgtgtgcacagacctgtgtgtgcatctgtctccatgtacctatgtcagtgtgtggcacagatgggatgctgtgggtgcatctgtatgtgtgtggacacaggtgcctgtgtgggcatgcgtacgtgtgtg

SEQ ID NO: 403287 - DNA, 447 bp, Homo sapiens
tcatgttattattgcaacattcttaggtggttttatgcagaaatttatgtaagaagtctccattgataatggtaaaacctattaaatgatacctctttttctttctcgtttttttctccctgtatgtaaggaagcacgtttttttgttaggtcaatagaacacttgaagcaaatatttaatgcacatgttcaaaatggtaagtaaacagatgttagaaacatcactgtttgatctaaaagaggcttcctgatttaacaggatgtgaatttaaagatttacaacctattaaatttttatttgattatcctgcagcctaacatattactgtgtattggctgaggtgcaagggtctcttgagcccagtagttcaaggctgcagtgagctatgatcacaccactgcatccagcctgggtgacagagtgagaccctgtctctaaaaaaaaaa

SEQ ID NO: 403288 - DNA, 2390 bp, Homo sapiens
  misc_feature (1359)..(1359): n is a, c, g, or t
  misc_feature (1523)..(1523): n is a, c, g, or t
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcaggtagtgtaaaaaattgtgttccaacagtaacagtggcattattttgaagcagtttctctcctcttttttaggtagaaacttaaaagagatctttgtcttgtggcacagttagttagntctgctatcatagtctagaaatataatctatttgtagctgagtaaagaataccagtcttgcttttacttatttaatgaaatattatatgtttcattctacaacaaagtaaaaccctttagttagaagccaagaaaatttcttatttttagaatttaataatggnaaggcaaaaatatgatattttataaccttatatcttgttttatttggatttaggtgccaaaattacccagagtaaaagaaaaaaaatttggccttgttactagtgatactaccttgtacttaactgtttctcagaaaaggggttactaagcttttgttcatagtggaaaatacatatattcattgaagatttcaactgagaaaataatgctgtttagtatccaaggctctaacttcttaggtgccttgtaacattttggttgtcttagtcaaaaaataattgtagggccatttaaaccaatatgcttttatttgttttgcggagtgcatagtcaaaactatgtaatatgccttccctttgttgtactacttggcctccaaaagatttcaagtgaacagatgtatatactgtatgcatttgttaatttaatttgcatgggagatggactggagctgtgaaagaatcttaactatctcgtaggagagactaggattaaaatctaataatatctatggatgaattaatcagtaatataaagcaatacctaatttattggtaatttatttggacagaatacagtctgtacaagcttagagaaagaggagttcaatttggaccaggaaaataagaaaatttcattgatgaggcgagatttgcattaaaccttgaataatgggtatagaatttaattaggtaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403289 - DNA, 7768 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403290 - DNA, 5937 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcg

SEQ ID NO: 403291 - DNA, 7963 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctcccttctggagcaatactgtggcagtgttgtacaggatacattaaagcagagagagagagatatgagaacatcgagggtctagtctttctcatggattctgacccacaggccatttcctcattcttcctcagacccctgattttagaagtgaaggaccagagttcctctgtaaattgtccagggactgtgtgaatgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403292 - DNA, 7021 bp, Homo sapiens
  misc_feature (63)..(63): n is a, c, g, or t
tcactaaataaaaagtaatcaatgtcaaccaacaaacacgaaccagccttagggagaactagngaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403293 - DNA, 7723 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgccttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403294 - DNA, 4749 bp, Homo sapiens
catgagtctccaatctactcctgaccctcatgtttcatccagccaagtagtaatatttgttgaaatagcatgtatgtgttgctttgtgatgtatcctcagtatccatcagctttcaagttaaaagctcattcaagttaatattgattcagaatctttggcaaagaatcaccagtgcattttttattagttttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403295 - DNA, 4267 bp, Homo sapiens
ctcaaaaaaaaaaaaaaaaaggattcagggtacatatatgtattacttagctattactgcggagtaaatcatcccaaaacttggctgaaaataacaaatatttattatctcacagttgttgtgggtcagtaatctgtgttctccttatctaggtgcctctggcttagtctctcatgaggctgtagttaaggtgctgcatctgaaagctcaactgggatggggacagggtgattcacttctaagcacaattgttggcaagattcagttatgccacatgtgcctctccatacagcagctcacaacacggaacctggcttcctgcagaacaagtgagagtgaatatgagtgcctcaaggcagaagaagcagtcttttggaacgtggtcttggaagtaacatgtatcacctctacctgcttctgttgctagaagcaagtcatcagcctccatgcaaggagaggagactataggaaacacgaataccaggaggaggggatcactgggtttcatcttaaaggctgtctactatatactagataattgttataaaaattattctaaaatcttactgttcaaggagaaataaaaatcaaccataagttattattaagttttaaacaaatctttctccctctccccccttaataatccacactcatcagttttcttgctctctttctttttagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403296 - DNA, 4466 bp, Homo sapiens
ctcaaaaaaaaaaaaaaaaaggattcagggtacatatatgtattacttagctattactgcggagtaaatcatcccaaaacttggctgaaaataacaaatatttattatctcacagttgttgtgggtcagtaatctgtgttctccttatctaggtgcctctggcttagtctctcatgaggctgtagttaaggtgctgcatctgaaagctcaactgggatggggacagggtgattcacttctaagcacaattgttggcaagattcagttatgccacatgtgcctctccatacagcagctcacaacacggaacctggcttcctgcagaacaagtgagagtgaatatgagtgcctcaaggcagaagaagcagtcttttggaacgtggtcttggaagtaacatgtatcacctctacctgcttctgttgctagaagcaagtcatcagcctccatgcaaggagaggagactataggaaacacgaataccaggaggaggggatcactgggtttcatcttaaaggctgtctactatatactagataattgttataaaaattattctaaaatcttactgttcaaggagaaataaaaatcaaccataagttattattaagttttaaacaaatctttctccctctccccccttaataatccacactcatcagttttcttgctctctttctttttagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggtcagtacaatagaacgagatcaggcaaaaggtcattggatgttttcttgagtgcctggttaataacagttatgaagaaaatttgacaagtttaattcacctagttacaaagaaaagcatttttatgtaataactcttaagtcaataacaattattgtttagttgtctataataggttatttttgtgtcccatttgcaggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403297 - DNA, 2559 bp, Homo sapiens
gcggccgcctactactactactgctcgaattcaagcttctaacgatgtacggggatttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403298 - DNA, 923 bp, Homo sapiens
tatcatctatggctctttgttattatagaatgtctacataggtatttatttgcctttcttcctatcaatcagatttatttattttaaaagcccttgataagtagtaaaatatttaactgcttttcttaaccatacaagtcagaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403299 - DNA, 4034 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggtaagtaaacagatgttagaaacatcactgtttgatctaaaagaggcttcctgatttaacaggatgtgaatttaaagatttacaacctattaaatttttatttgattatcctgcagcctaacatattactgtgtattggctgaggtgcaagggtctcttgagcccagtagttcaaggctgcagtgagctatgatcacaccactgcatccagcctgggtgacagagtgagaccctgtctctaaaaaaaaaa

SEQ ID NO: 403300 - DNA, 2378 bp, Homo sapiens
  misc_feature (1359)..(1359): n is a, c, g, or t
  misc_feature (1523)..(1523): n is a, c, g, or t
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcaggtagtgtaaaaaattgtgttccaacagtaacagtggcattattttgaagcagtttctctcctcttttttaggtagaaacttaaaagagatctttgtcttgtggcacagttagttagntctgctatcatagtctagaaatataatctatttgtagctgagtaaagaataccagtcttgcttttacttatttaatgaaatattatatgtttcattctacaacaaagtaaaaccctttagttagaagccaagaaaatttcttatttttagaatttaataatggnaaggcaaaaatatgatattttataaccttatatcttgttttatttggatttaggtgccaaaattacccagagtaaaagaaaaaaaatttggccttgttactagtgatactaccttgtacttaactgtttctcagaaaaggggttactaagcttttgttcatagtggaaaatacatatattcattgaagatttcaactgagaaaataatgctgtttagtatccaaggctctaacttcttaggtgccttgtaacattttggttgtcttagtcaaaaaataattgtagggccatttaaaccaatatgcttttatttgttttgcggagtgcatagtcaaaactatgtaatatgccttccctttgttgtactacttggcctccaaaagatttcaagtgaacagatgtatatactgtatgcatttgttaatttaatttgcatgggagatggactggagctgtgaaagaatcttaactatctcgtaggagagactaggattaaaatctaataatatctatggatgaattaatcagtaatataaagcaatacctaatttattggtaatttatttggacagaatacagtctgtacaagcttagagaaagaggagttcaatttggaccaggaaaataagaaaatttcattgatgaggcgagatttgcattaaaccttgaataatgggtatagaatttaattaggtaatagaaaagaggggaaagtgtttcaggtaatcaggagaagatttgagagaagattcgaatgtagaactatatatgcacgacaggtaccttgtaaaaagccattttctaactataggtctccttgggaccatttataccactccgcgacatacatcacgt

SEQ ID NO: 403301 - DNA, 405 bp, Homo sapiens
ggagtggttccttaaatgtcgaagaagggtaggtgccagttaatttttgtttctctgtgtgttacatgtatgtatgaaattatttgacttgtaggtgaatctattaaaaagtttcattatttgattgggtgcagtggttcacatctgtaatcctagcactttgggaagccaaggcaggaagatcatttgagcccaggagttcgagaccaccctgggcaacatagtaagactctgtctttacaaaaaatttaaaaattagctggatgtgatgcgcacacctgtagtcccagctactcgggaggctgaggcaggaggattgcttgaacccaggagtttgaggctgcagtgagctatgatcatgccctgcattccagccagtgcaacagagtgacaccctgtctctta

SEQ ID NO: 403302 - DNA, 580 bp, Homo sapiens
agagggcatttcctaatctccactataccaatattttcatcaagttatttgtgcttagacttgagacttccctgaaaaatctggcactggagtcacttcagatggactcacactctttattcttggtttgtatttctgcagcccttctggagcaatactgtggcagtgttgtacaggatacattaaagcagagagagagagatatgagaacatcgagggtctagtctttctcatggattctgacccacaggccatttcctcattcttcctcagacccctgattttagaagtgaaggaccagagttcctctgtaaattgtccagggactgtgtgaatgtatgttgctttaaatgtattatctatagtattggcatggttagtgaaaatccacttattctttttagagcttgatttcttttctggaaaaggaggaatttcactcaaatgatccctgtagttccttctgtttctgttaagattgaatcatcctgtcagttggcttcaagaggattatgacatgtgtaagaaggagattgttgatctgtacagacaagcagttctaggatctttgcttacattg

SEQ ID NO: 403303 - DNA, 683 bp, Homo sapiens
gaggggaaagtgtttcaggtaatcaggagaagatttgagagaagattcgaatgtagaactatatatgcaacaacaaagaaacttatgttataaagtaatgagaaactgtcaaataagcagagtggccaaattttgcataaattcaaaagccaagtgaaaaatgagagttgattcaggaaatgagagaaactcctaaagatttatgagaaggaagtgaaataatcaaaggaatattgaagatttctttcttcaggataaactggaattagggaggctagttatctggttttttaagtcatctgtaacagatgtggagtgctgggtgggagccaggactaatatggtgtatgggaagagagaaaggactagtacaaaaattgttttggggccgggcacggtggctgacacctgtaatcccagcactttgggagcccgaggtgggcggattgcctgagctcaggagtttgagaccagcctgggtaacacggtgaaaccctgtctctactaaaatacaaaaaattagccgggcatggcggcatgcgcctgtagtcccagcaacttggaaggctgaggcaggagaattgcttgaacccaggaggcggaggttgcagtgagctaagatcttgccactacactccagcctgggcgacagagcgagactccgtctcaaaaaaaaaaaaaat

SEQ ID NO: 403304 - DNA, 211 bp, Homo sapiens
ggaagtgtttgcatggagaaagctccactgaggatatgtgtcacactttggagtcggctggtcttagccctcagctgttgttggtaaggtttttttggttgctggatgctgttcttccttgtgaatgtcacccagaagtgtcagtcttctttttttttttaactattgtcttttaggatatcacagaatgtccatgaaaactttctaaaaa

SEQ ID NO: 403305 - DNA, 692 bp, Homo sapiens
gcccagaaggtagtgatgttttcttattaaattcttattgaaattagactttgtgtttttttattacaatttgggacagtgtgcaatatgaatttgcactttgctgctaataaactcattgggatatttgtaagctattatttttccattactgaacacagtcctccattctcaaaacccttaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaaggtaagtacctcacaggatttcagagctattttggagttgcaggcttagcagacacatggattttcatatttaatagaagctgtccagtacttttgtgactggtataatttggtgtgaggttccaactccctcattccctgcttgattccgttctttttatttaccttctgtactgctccccttggagttttgccctctcagctgtctgctcttctcattctccatattattcctggacagactcattttctccctcttatatatctctaggcctgaccaatccctagag

SEQ ID NO: 403306 - DNA, 7799 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttcatgttgtttcctacattcataagtataactaa

SEQ ID NO: 403307 - DNA, 6773 bp, Homo sapiens
ttattatttttttgagatggggtctcgccctgttgcccaggctggagtgcagttggtgtgacctcagcttactgcaacctccacctcccaggttcaagcaattctcctgccccagcctcccaagtagctaagattacaggcacccaccaccatgcatggctaatttttgtatatttagtagaggcggggtttcaccatgttggccaggctgatttcaaactcttgacctcaagtgatccaactgccttggcctccggagtgctgggattataggagtgagccaccatgcctggcagaatattttctgatgttgactttgtagcttttaaaatgacttttggttattaaataaaactaaacatttagcatcttagaatggaactgaagtaaaaatgtaatgaccgcaataacattgtacattcaaatcacttttttttttttattaggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403308 - DNA, 7452 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403309 - DNA, 7967 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggtcagtacaatagaacgagatcaggcaaaaggtcattggatgttttcttgagtgcctggttaataacagttatgaagaaaatttgacaagtttaattcacctagttacaaagaaaagcatttttatgtaataactcttaagtcaataacaattattgtttagttgtctataataggttatttttgtgtcccatttgcaggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403310 - DNA, 4284 bp, Homo sapiens
gtggttatgtaatgctgtctcactgtgacattgtatttctctcataactaatgatgtgactcttttcttcatgcttagtggcaatttagacatactcttatacagcctagttctgatttttattaaatcagattttaaatgaaattaaagatttcatgaactttataaatattacatgagatataaaaaatgaaatcaaaatagtctatatagtttaataagcttaagaaagagtaatttatgtgtaataaaagtgagactatataagcattctatttactacttttacttgctatctaggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 403311 - DNA, 4823 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaaggttaagtgaatctcccatagctagaattatggttgttaattccacacttttatgtagtactttattaactgtataggtgaactttgccttttatcattgtgatgacgtatcagaaggagataagaaaaatgaaaagagaatactgcattaaggaaactggtcatgaactatggccaattttaatttacttttccagattgttagatagcatattaaactaggtttttataagatgttgttcagctttgaactgtgaacaggttaacatgctaccattgctgcatattccgattagacatttataatggaagcatccaacatcaaattgaagcaggttcaaatgaagtagttaatttgatctacctatatatatgatatatataataacataagtataccaaatacaacattagtcttaactaatattctaaacccatggatatggggacttgtatttgaccccaagaaattaatagtactagcttccattgttgaagactttttctgatgtgttcttgagaatggttgtatgactagagtgtgtacgtgtgtgtgcatgcatgtgtgtgtgcatgtacccacaaacactgaattatttgctttggggatgtgaggaaattatagattgttggttttaaaaagattatatggcagggcgcggtggctcacgcctgtaatcctagcactttggaaaggcgaggctggtggatcacctgaggtcaggagtttgagaccagcctgaccaacaaggtgaaaccccatctctactaaaaatagaaaaactagccaggcatggtggtgggcgcctgtaatcccagctactcaggaggctgaggcaggataatcgcttgaacctgggaggtggaggttgcagtgagccgagatcgtgccactgtactccagcctgggcaacaagaatgaaactctgtctca

SEQ ID NO: 403312 - DNA, 3319 bp, Homo sapiens
ataatgaaaacaaaagtgtataatacactataacacgtactatattgggcttgcgtagtactatgggaatctatagtaggagcatttaaagccagccttgacggggctaatctccggaagagcaattaatcttttcaaaatccgactcttgcaggatacggtcccccactggcctgccactagtttaaaacgaattagtttctgtgaaacatcaggatcgtgccaatagtaggggaccaataagactgaataagtcaaagggctgcgcggacaagtccaattagaacacctctggctaaaagccagaatgaatgaaagggttcatgcctcggcgtagacacacaactgggactgaaaaatctgccccaagcctccacgtcgactttggctccacctgcagcggcggcgccgtagtcacgtgacccgggcccccgcgccctaggcgcctgggccagcctgcgcctgcgcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtttcagactctgcttcacagcaaagggaacactcagacctccaaagtgtcatcactgcaggctgagccacttccaaggctttctgttaaaaagttattagaaggaggaaaaggtggcattgcagacagtgtagcctattaaatcagttgcaaaatagtataggagtttctgtccttcttcattgtctcatacccttaaaattattatgtttccaattgcattatttttgactaaaatctagggaaatagaatcatggaattatgtattagctctagaataccacagtatccaagtaggtctaaatgcatca

SEQ ID NO: 403313 - DNA, 2056 bp, Homo sapiens
actgtactctcaagcgcgccgcgaaaggagggagcagcttccgggacctggcgcggcttttgtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatggattcagtgtcatttgaagatgtggctgtggcctttactcaggaggagtgggctttgctggatccttctcaaaagaatctctacagagatgtgatgcaagaaatcttcaggaacctggcttctgtaggaaacaaatcagaagaccagaatatccaagatgacttcaaaaatcctgggagaaatctaagcagtcatgtggtagagagactgtttgaaattaaagaaggcagtcaatatggagaaaccttcagccaggattcaaatttgaatctgaataagaaagtttctactggagtaaagccatgtgaatgcagtgtgtgtggaaaagtcttcatatgtcattcagcccttcataggcacatcctgtctcacattggaaacaaactatttgagtgtgaggaatgtccagagaagttatatcattgcaaacaatgtgggaaagcctttatctctctcaccagtgttgacagacacatggtaacacacactagtaatgggccttataagggtccagtgtatgagaagccttttgattttcctagtgtatttcaaatgcctcagagcacttacactggagagaaaacatataaatgtaaacattgtgataaagccttcaattattcaagttatcttcgtgaacatgaaagaactcatactggagagaaaccctatgcatgtaagaaatgtggtaaatcattcactttttccagttctcttcgccaacatgaaagatctcatactggagagaaaccctatgaatgtaaggaatgtggcaaagccttcagtcgttccacttacttgggaatacatgaaagaacgcatactggagaaaaaccctatgaatgtataaaatgtggcaaagcctttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacacgtgaaaaaattaaaaactcaaattagagagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttgtttctcatcagttaacataatttttgtctattcatttaaaaatttgttggatccctagactaagttgaaatgtatttctaatagtaggcaattttaattttcatgtagttgtttaattgttctctaattaatggaccaatgaaaaatgagttcatgtgtgtgtgtgtgtgtgtgtgtgtgtgtgtgtgtattctacctttttatgggaaaactacttttttgttgtaaagattttcttctgttttctttgctaataaagaattgttattaatttgc

SEQ ID NO: 403314 - DNA, 3309 bp, Homo sapiens
actgtactctcaagcgcgccgcgaaaggagggagcagcttccgggacctggcgcggcttttgtgttgggcagcgcgaatgtggcgagctcggtgcgtctccgctgctccttccccttatccctgggaggtccaagtggtcccgcggcagcttctgttgctctgggacctgcaggtcccggaaggtccttagggaggaccccagacaccggagactgggaaatggattcagtgtcatttgaagatgtggctgtggcctttactcaggaggagtgggctttgctggatccttctcaaaagaatctctacagagatgtgatgcaagaaatcttcaggaacctggcttctgtaggaaacaaatcagaagaccagaatatccaagatgacttcaaaaatcctgggagaaatctaagcagtcatgtggtagagagactgtttgaaattaaagaaggcagtcaatatggagaaaccttcagccaggattcaaatttgaatctgaataagaaagtttctactggagtaaagccatgtgaatgcagtgtgtgtggaaaagtcttcatatgtcattcagcccttcataggcacatcctgtctcacattggaaacaaactatttgagtgtgaggaatgtccagagaagttatatcattgcaaacaatgtgggaaagcctttatctctctcaccagtgttgacagacacatggtaacacacactagtaatgggccttataagggtccagtgtatgagaagccttttgattttcctagtgtatttcaaatgcctcagagcacttacactggagagaaaacatataaatgtaaacattgtgataaagccttcaattattcaagttatcttcgtgaacatgaaagaactcatactggagagaaaccctatgcatgtaagaaatgtggtaaatcattcactttttccagttctcttcgccaacatgaaagatctcatactggagagaaaccctatgaatgtaaggaatgtggcaaagccttcagtcgttccacttacttgggaatacatgaaagaacgcatactggagaaaaaccctatgaatgtataaaatgtggcaaagcctttagatgttccagagtcctcagagtccatgaaaggactcacagtggagaaaagccctatgaatgtaaacaatgtggtaaagccttcaaatattctagtaacctatgtgagcatgaaagaactcacactggagtgaaaccttatggatgtaaggaatgtggtaagtcgtttacttcttccagtgcccttcgaagccatgaaaggactcatactggagaaaaaccctatgaatgtaagaaatgtggtaaagccttcagttgttccagttcccttcgaaagcatgaaagagcttatatgtggtaaaaaacaacaacaacaaaacacctctgtcaatgtaagaagtgtgttaaagctttcagttattctagtttcattagaacacgtgaaaaaattaaaaactcaaattagagagaaacccaacacatgtaaggaagattagaatgtatgcaattttcctagttcccttctaaaacttagaaggacccgtcctgggaaagaacgtcataaaatacgaaaaatgtgttagaacactttattttcccagccgctttcaaatatatttttatcagtggttcattgttaaagaaggtgtctatactttagattttcagttttttgcagggaatcatggagctgagaatttcacagatactttataagccatagtacatgagcttaataggctgtgttttgtttctcatcagttaacataatttttgtctattcatttaaaaatttgttggatccctagactaagttgaaatgtatttctaatagtaggcaattttaattttcatgtagttgtttaattgttctctaattaatggaccaatgaaaaatgagttcatgtgtgtgtgtgtgtgtgtgtgtgtgtgtgtgtgtattctacctttttatgggaaaactacttttttgttgtaaagattttcttctgttttctttgctaataaagaattgttattaatttgcatgtatgtgaagtttatatagtctcatgtacattgttattttcattttctttcctttattctgtcatgagttttggctgttacttgcatagttcactttttttaaaaaatgttatgtttttagagagggtctcactttgtcagctaggctgaagtgtagtggtaataatagtcttagctcactgcagcctcaaattcctgggctcaagtgattctcccaccttagcctcctatgtagctggagctacagacacatgccaccatgctcagctaattatataattttaaaaattttttatagagatgggatctcgctgtattgtctaggctggtattgaattcctggcctcaagctatcctcctgcctcagcctgtctacatgttggggttactgacatgagctaccacacctggcccactttttactttgaattaagaagagagaactgtgattggacagtatgcttgtctaatctgcgtgtgaaagcattcagtctcaccatcaagtatattgtggatttttcataaatattctcaaacaggctcaggaagttttcttgtgttttttatttattgtttcatggtaaaggagtgttgaactcttatgacatgtttttttctgcatctattgagatgatttgtggtttttggcattctactgatagtctattacgttaactggctttcagatataaatatattatggttatctgggtgaaatttgtcttcatcatggaatataagtattttatctacaggttgaacatctgtaaaccccagattccaataccaaatctgaaatgctccgaagtcaaaaactgtttgagcaccagtcttatgctcaacagaaatgctcattagaggatttttgatatttggattagggatgctcatccagtaagttttctgcaaatattccaaaatgttaaaagtctgaaatccaaagcacttccgttcccaagtatttcagataagaaacactcaacccatattgataacgttcaattttccagtgtattgttggggccttttgcatttatagtcaaattggtgtgccctagtataccatatagtatagcatcatctgtatatatagcatgtctacatgtatacttatatgtgtataagtagctatataatatgtggtatagtacagttttgtaagttactatgaattatgcataactagtttatattatgtgtaattagcactacaataaattgtatattacaggattatggcattataacata

SEQ ID NO: 403315 - DNA, 196 bp, Homo sapiens
caaagtgactttgagcccttcctgttagaggtgaaatgtatgtttcctcgccctgattctgggcaggtttgtgatgacagtggaagtcatgctaaatgatttctgaagctatatataaagctaatatagcctaagcaagtgttactaaggttttataaagtcatacagcctttgaatttttctttatcttggaact

SEQ ID NO: 403316 - DNA, 773 bp, Homo sapiens
aagcccttctccacctgatgtgagaaagcagacggtcaccacttcagaggactaaaggagaagcaatgtcctcagggaaaactcaggtttttgttggagcaaaaaggtgaaggcatggttgagagaacagagtgatgacataagggagtttgctgaatacaaagcaacggttccagaaggcatgtggaagccctgagcaagagaggaggaacagagggctcatccaggagcagtggggaaaatcaggcaaagagattgatgactgaggtggacttatatttaagcattaactgatttaaaaaaaaaaaaaagtcaatgggaatgggagtgattactggccctactgctgcaaggacttggctcactagacctgatgaaggggtgttcctgcaggagtttctgcacaggccactgcttgggatgttcttgagccagaggttgtagtttcagctcctgtacagcttagcataacattggcttcagaggcttaggcttcaacacctgacacaatgttgactgtctcagaggtgaggtgttaagaataccacagattgaatacatgaggtgttaaggacctcagaggttgggtattagttagttcagtcccagagagtagggcaattggcactcctagaagatgcgtctctatacctgaacagcctgcggtacgctggtcccagcagtctgcaagtgatacatgcgattttccaatctttttgaatcaacagcatgttctcatcagtctgtaattgtagatcagaggatactttatc

SEQ ID NO: 403317 - DNA, 487 bp, Homo sapiens
tgccactttgtgagcctctgtgtcttccacaaaagtgggcgagttgggtcagatgttatccagcgtgactgccagctctaaaagtctttaatgccgagccaatgagccattcttgtagggcttaccagtgtgactcagtaaacatttgatgagtactttatatcagaaacagggcacaaaggttaatataacacctgtgcccacatccagggtggggccatgtcataagcagtcccattgctccaataatcggagaatagctaacttgtaccaggcagtgttctggatactttccattgatttatctattcatgaaatacattagcaaaatgaattagcaggaaaaaaaagtgctagctgggcactactgttctgattagagagaggaggaaactaaggcacggagaggttaagtaatttgccccaggtttcgtagctaacaagtgaaggagccagaatttcaacctagggaacctagctccagaac

SEQ ID NO: 403318 - DNA, 708 bp, Homo sapiens
tcacccaggctggagtgcagtggcacaatttcggctcactgcaagctccgccccccgggttcatgctgttctcctgcctcagcctcccgagtagctgggactacaggcgcccgccaccacacccagctgattttttgtatttttagtagagacggggtttcactgtgttagccaggatggtcttgatctcctgacctcgtgatctgcccgccttggcttcccaaagtgctgggattacaggcgtgagccaccatgcccggcccagtttcttttaatagatgaaaactgatgaaacagtgactagtaggtcaaaacagagtttgcaagaatatacaatatggtacggacaattacctggccacttccttagtttatgatgctttagcataggtaaacagctttaatagatccctcaaagtcaaagcctgacacccaacaaacattaaaaatccctttgcttgttcagtaagagaagtaaaaattaaattaaaataaaatatctcaagaggacctagagaggtcaccagtgggtaatctcaatcaccacacaatctccaaatgaaagactgctagagggcactgctgtctgagacttggaggcttgagtggcagtgttacagaaatgctggcagtacacaaactgaagaacaaacagatcttagggactctggaccgtattactaaattatagatcagatcactttgtaa

SEQ ID NO: 403319 - DNA, 452 bp, Homo sapiens
gcggccgcctgcagggcctggtggagctggtaagcgccactctcccgcagggagcacatggtcttgaggctccacgtgctgagcgcgtcgtcgatggacttggccagggattgcacctgctcggtgaaggagtcctccagctcggctctcggccgtgggtgaccgcaccttgcgcagggagatccgccgtggcaggcggctctccagaagcgagttgcggattttctcgaagttcttgctgagctggtattggcggaaggcggtttggatggtgcaagcggcgcgccgggacaccagttcatgtcagagatgcatacagaagtacttatgggtaaaatgcatgatatcttgaagttgtgttaaaatattctgtcaaaaaatgtggaagagttagatgacacaatattaatgttaataaatattaataaaatggttacagctggatgatagct

SEQ ID NO: 403320 - DNA, 739 bp, Homo sapiens
ctctcccctcctgaacattccagacattccactcaggctgacttaatgccacctggccagaaaaaaacagtgtccattcccccttttctaaaaccttgattttgtgatcgtttgaacctttgagtttagaatcactgtattataacttccttgggatcctacctttgcagctagccacattccaaattataagactctctctggaagcccgttgtagacaaccaaaagccctgatgatgtaagggagctcgccagacacacactttcatactcaccaccttgtcttaagctgcttaccatctgctggccccagtcagctcttctgggaaaagctgcgtttggaaaaggagttccccgaatgtatttaatatcaaatggagcaatggttctcaaagtgtgctccctggagcagcagcagcaccagcatctcctgggaacgctttagacatgcacatcctccagccccacccacccctgctgagttagaagctctgcggtgaggccagtgcactcaagtttgggaactaccaatatagagtaaaagatgggggagaaaaccccttgagtatcaaatttagaaggccacaatagtgaagcgtctgtgcctactgtttgcagaatgtggaaggtttagggtgtttactactgtatgttgaataatgattctcttaaaacttttgtgaattgtaaaagtaaatccctaggaatgctgggcagtgataacctgactctcccattt

SEQ ID NO: 403321 - DNA, 649 bp, Homo sapiens
cttggaattgtcttggcacccttgttgaaaatcaattgactgtaaagatgagggcttatttctggactctcaattctattccgttgatctataggtctattcttatttagtacctcactgtcttgattatgtggctttgtattttaatagcaagtttggaatcaagaaatgtgaattctgcaattttgtttttccttttcaatattgttttgagtattattggcccctttgaatctccatatgaattttaggattggctagtcaatttctgcaaagaaaccagctgagaattttgatagggactgtgttaggtctgtagatcaatttggggtatcttgtcatttcaacaatagtaagtcttttgtttcatgaacatgggctgtctttccacttatttaggtcttctctcatttctttcaaaaaatctagattttaggatataagtttgggactttttaattaaatttattcctaagcattttattatcttgatgatattacaaatataattttttaaaacttccttttgagactgttcattgctaatatagaaatacaatagttttttgtgtgtttttatatattgaccttgtatcctgcaacctcgttgaactattttattagttctaacagttttttttcttttttt

SEQ ID NO: 403322 - DNA, 142 bp, Homo sapiens
atcttaacaatgcttggctcattagcgggcccatatgggggcttctgggctagttgctctgggcaatacaccggcagagcctaacttttcagatggccaggccaggacccagtggaggagcactccttggccagcccctgac

SEQ ID NO: 403323 - DNA, 362 bp, Homo sapiens
ccctttttcctgtctttgctatttgggatttggtgtaatacattcatcaaatatgattttactattgctgtgacatgaagcccagatgagtttcacatttgtttcaaactcgaatgctgaaatttggggaataaaggtagagttattgtgttcgttaattaacaatgtactgttagatctttaaaataaataaataaataagtatcctcaaagaagtgaacctaaccctggccgttaaaaagcctggagactactagatttctttattctatgcagtacacctgggcaggctttggatgccgctgcagccatctatcattctgtaaagacaaacgcccttaatagatttctttgtcattgac

SEQ ID NO: 403324 - DNA, 291 bp, Homo sapiens
aagtttaaaatagaagcaatgcaggagaccaaggaatggatgttttgaaaaccacagactggaaaatttgatttatgttataatgagtgacttttaaaatgtatatgaactcctattcaggaaaatattcaggttctccttaaaccttttaaggacatattgtccagtcgtggattctatttaaaaactttgaaacagaaaataatcctccgtttaataaaagcctccagaataaacaacttctttaagcttttctctaacgtctcccatattctctgtgaaaattaccag

SEQ ID NO: 403325 - DNA, 368 bp, Homo sapiens
aatctttcttctttctccccccggcttctaaacaaccccatctgcctgatagatcgatataaatttaaaggcctagtgtttactcagaatgtttggtttgtgtgtctattgcagtacacgtagtgcaaatatgaaaaaaatatctaattttcttaatagaaagtctataattgattcaatctaatgtatttctgaaagattaataaagctgcttttcctcaagacaataagacaaacattaaacaaaaacttctctcaggagtgaatggtaaccccagtgacctccttctcatgatctgcaagcactttataaataaacacatccaagtgggatgtgatggttggatccacagtcatttctcctgaac

SEQ ID NO: 403326 - DNA, 355 bp, Homo sapiens
cagaccaccacaactgacataataataatgaaaaagtttgaaatactgtgagaattatcaaagtgtaaaatagtgacatggagcaagcacatgctattggaaaaatgtatgacacaggattgccacaagccttcagtttattaaaaaaaagcagtgtctgggaattgcaataaaacgtagcacagcaaaacaagatatggctgtaatttgaaatagaattggtaggatttgccgatggattggattttgtgagtaaagggaggagttaagaatgaatcctaagtgttttgatcatttgggtgaatacagatgccatctgtcgagcagagacactttttgaggagagaggtaggtg

SEQ ID NO: 403327 - DNA, 1232 bp, Homo sapiens
tactcccagttcctaagggaagagtttctaaaccctccaattcagcctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagg

SEQ ID NO: 403328 - DNA, 1317 bp, Homo sapiens
ctcctgccagtgtctgcctctctgcccccacgggggtttatttgatctcacattaaccaaggaggagaatgtgagaaaagggggaaaatgcccaggaggaagcaggagcagcccaagcgccttccctcaccctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcagctgcaaatcagaaggagcccatgaatcttaattttaaagtgaaagaggagcctaaggaaggggagtccctaagcacgactttgcctcggtccagctatgtgttcagcccggaatctgaagtgtcagccccaggcgtctctgaggacgcactaaagccccaggaagggaagggaagtgtgctaaggcgggatgtgtcagtcaaagcagcctctgaacttctcatgaaactctcagcggaaagctacaaggaaacacagatggtgaagattaaagaggaacccatggaggttgacatccaggactcccatgtctcgatatcacccagccggaatgttggctacagcactttaatcgggcgagagaaaaccgaacccttacagaagatgccagagggcagagtacccccagagagaaacctcttcagtcaggatatctctgtgaaaatggcttccgagctcctctttcaactgtcagaaaaagtgagcaaagagcacaatcatacaaaagaaaacaccatccggaccacgaccagg

SEQ ID NO: 403329 - DNA, 1154 bp, Homo sapiens
ctcctgccagtgtctgcctctctgcccccacgggggtttatttgatctcacattaaccaaggaggagaatgtgagaaaagggggaaaatgcccaggaggaagcaggagcagcccaagcgccttccctcaccctcagaagaggaaagtggaaagcctttccagtgtccaatatgtggtttggttattaaaaggaagagttactggaagcggcacatggtgattcacacaggtttaaaaagtcatcagtgtccgctctgtccattccggtgtgctcgcaaggacaatctcaaatcccacatgaaggttcatcagcaccaggatcggggagagacctttcagtgccagctgtgcccttttacttcctcacgccacttcagcctgaaactccacatgcgttgccatcagcacttcctgaggacagaagccaaggtgaaggaggagatcccagacccagatgtcaagggatctccccacctcagtgacagtgcctgcctggggcagcaaagggaaggaggagggacagagctagtggggaccatgatgacgtctaacactccagagaggactagccagggaggggctggcgtctcgcctttgctggtgaaggaggaacccaaggaagataacggcctgcccacctcctttactttgaatgctgccgacaggcccgccaaccacacaaagctgaaagacccctccgagtatgtggccaacagtgcgtcagcattgttcagccaggacatctctgttaagatggcgtctgattttctcatgaagctgtcaggatctcctcaattaaagaagagtataagcttttgcttcaaagttgacaacatttggcaactgccctcattccttataataaatggaagataagcagtatccagaactcacaatatgccctaaagccatctgtaattctgtgtcaactacttggttattactcagttaactgttatttgggaaatgtatttaatctctctaggtctgagatctctcatctgcaaaatggggataatactagtgcctacctcaaagggtggctgtgagaattagataaattaatacaggtaaatacttggtgtgttacccagctcatgttatgtgctcaataaatgatagatctagctctatccatatgtatctaaaaaaaa

SEQ ID NO: 403330 - DNA, 482 bp, Homo sapiens
ttttttgttttgttttgtgtgtgtgtgtgtgtgtgtgtgtgtgtgtgtgtgtgtttctaaggtagagctgactttatgaggggctgggggcaacagagggcagctggcagttccatctgcaacacaaatactcagaccggtctgctcttagaggctctgagcccggcccacccagagaatgttctcgcctgtcaccctcccagcatctccacagaagaaccatctactcaccaggaccaagctgtactgctaatgactagctacttgaattccgcatgaaaagaggcagatgagaaactggagatttacatacttcgaatctacatatagtggaaatccctttagactgttgccggatgggataaaaagatctatggagcagagttagaggcctttgtaaaataaatgacacagggaagcgctggatctctgtatgaaggggaattcctaagtttgtgtgtactcattttctgaagaccctg

SEQ ID NO: 403331 - DNA, 563 bp, Homo sapiens
gtgagacttcgtctcaaaaaaaaaaaaaaaaatggttgcagatgactaatgtcaccaaacaccactgaatgggtggacaacactctgtggcagaatttgtgaaggcactgaagtactagttgtggtgcttagggaagagacaccagctcacctaacctgtgggatttgttgcaacagagggcagctggcagttccatctgcaacacaaatactcagaccggtctgctcttagaggctctgagcccggcccacccagagaatgttctcgcctgtcaccctcccagcatctccacagaagaaccatctactcaccaggaccaagctgtactgctaatgactagctacttgaattccgcatgaaaagaggcagatgagaaactggagatttacatacttcgaatctacatatagtggaaatccctttagactgttgccggatgggataaaaagatctatggagcagagttagaggcctttgtaaaataaatgacacagggaagcgctggatctctgtatgaaggggaattcctaagtttgtgtgtactcattttctgaagaccctg

SEQ ID NO: 403332 - DNA, 421 bp, Homo sapiens
tgctgagacttatcctcagattgtcatttaagataagatatcataatacaggaaaacaaacatttattaccacagtagcctctaggcttttattgcacaacactgaggaaaagaataggatcatctccttatttatcattctggtttggctgctccagtccatatccttggtatttttcagtgcctaacctggaagctgatctccaggagctgtctcagtcaaagactggggatgaatgcggagatagtcctgatgtccaggggaagattctgccaaaatcagagcaatttaaaatgccagaaggaggggaagggaaaccacagctttaaacgaagacaaccaaaagaatgcaaactggatttatccgagatatttgacttttaaaaatctcaataaagttttccagttttctccaaagaa

SEQ ID NO: 403333 - DNA, 639 bp, Homo sapiens
tgcttgagaccaggaggtcagagcctgcagtgagctgtcattgtgccactgcactccagcctgggcaacagagggagatcctatctcaaaacaaaacaagtcgttaatataggtaagtttgtaagaatgattgtcatgaattaggaggtgagttcatttgctgcgggtaagtgataggagtggtagcttttatacaggaagtctaaacagaagttgggaatgtctactgaggtgtatgagaagggaaggtgactaaaaatgtgtaaaagaatagttaataaaaatcagaaccctacacaatacagtcatgtgttgcttaatgacggggatatgttctgagaaatgcattgttaggcgatttcatgcttgtgggaacatcagagagtgtatttacacaagcctagatggtatagtctactacacacctaggttatgtgggatagcctattgttcttaggctacaaactcatatagcatgttactttactgagtaccgtaggcagttgtaacacagtattaagtgcttgtgtatctaaaccaggggtgtccaatgttttggcttccctgagccacattggaagaagataaattgtcttgggccacacataaaatacaataacgatagctgataagctgagg

SEQ ID NO: 403334 - DNA, 475 bp, Homo sapiens
agcttaatggttatattacttctcattagttgcataaggatggaggagaagaggcaagtttatattctccatgataggattctgtggtgtttgaatatcttcatgagaagtatattattattaaagtagcccttaacattttaaaataacaggctgattttaaatatccaaaatcagattgtatggagaattattgtatttaaaagtgtaacttttagatgattttattataatagttttaaatggaaaatatttaaatatttccattttcattttggaagaaaaatggaaatatagatgagaaaaaatacttaatgtcaactttaactctgccatgcagaggtaataattttaaatcttttggaatgttttctcttagacgtttatgtgattatgtgtgtgtatttataaaaacaagattttctgctgctctgcctatggggtagccattcttttattcgtttgctttctttaa

SEQ ID NO: 403335 - DNA, 594 bp, Homo sapiens
tttgcttttcacaacacggcgacccctgacatttcaaagatcagttgtactagtgttgacatgcttttatgcctttgtttctctacattttcctatattccatttcttaagcatttcattaaacaagatgcatctagcaagactagatttcctagtcttgctttgtctgtagttaaatctatgaatgtaagtggaagaaagaagaaataaatgaaggaagatgtgtcagatatttgggaacagaggtgtttgacttaaagtggtgaggatttctcttgtatttcaaggggaattcaaagatgtcaaaagaatggaaatattaactttaagaaaaaaaaagacagacatttcgattgaatgaaatgtgtagatcgattttaggaaattgagaccttgacatatgttgattcttctgatctatgatcaccatgtgtctctccatgtatctgaatttcattggctttctctcagcaatgattttggtttggagtgtataatcttgaactaatttggcaaggatattatcttttaagttattttgaatgccattttatcattttgttttgtaatttgaaatgttgatttttttttttt

SEQ ID NO: 403336 - DNA, 514 bp, Homo sapiens
ggtctagccacagtggctcctttagtcctccactcaggacccttcctctgagcctacaaataatgcaggctggcctctcccattctcgaccctcattttcccccatcagcccagcgctccctgttccctctaggatgcttccaggaatatacagcaccgttacagagaggattgaattgcatggcttcttgagcaacctggaacacttgagccagccaaatttctgctttatttcagaccaccaggtataacagcagaattcttcatcctgattagaaaggtgttagtgtgcagtccatagagagagagacatcatggttaagaggcaggttcaagggcctggatacctcaactccatcctggctgtgccacttactttctggtggtggtggggaaagtgcttcatctctattttctcacctctaaaatgaggctgatattaatagttcctacctcaccgggatgttatgaaggttaaatgagatcatccatctgaagcacttagaaaaaaaaa

SEQ ID NO: 403337 - DNA, 310 bp, Homo sapiens
agaagggacaagatgatgttaaagacgaagcctgggcagggcacagtggctcacggttgtaatctcccaaagtgctaggattacaggcatgagccaccgcgcctggccccaaatgttctttattcccctttctctctctcctctccttcttgaattcccattctagatatattggtatgtttgatggtgtcccacagatttcttagacttcgttcattttttcttcgttttttcccatttgtgttactcaggtagtaaccgttattcccattgacctacttcaagttcaataattctctcttctgcctgc

SEQ ID NO: 403338 - DNA, 442 bp, Homo sapiens
tgtaatcccagcactttgggaggccaaggtggccaaccgctactgcatttcccctgcctggacactgttggttggttggatgggtggctctcctgaggtcaggagttcgagaccagcctggccaacgtggtgaaaccccgtctatactaaaaacacaaaaattagccgggcgtggtggcaggcgcctgtaatcccagctactcgggaggctgaggcatgagaatcgctagaacctgggaggcggaggttgcagtgagctgaggttgtaccattgcactccagcctgggcgacaagagcaagactttgtctcaaaaaaaaacaaaaacaccataccaagtgttggttgctcctattaaagcagaattggtggaaccaggcctcagcccaccccgctaaagacaggaaatgtgggaaacattaaaaatactacatcctaagtga

SEQ ID NO: 403339 - DNA, 463 bp, Homo sapiens
ctcaagaagacttacagaaatacaaaattgtcagcaagcaataaggtgaaaattacaatgtttggcatctaatcagattactagatgtggagaggcaggaaaatactcctcaagccataatgaagagaataactaacaaaacaaaaccaattcagaattgacatggatgttagaattagaagagaaggatgttaaaatagttatcatagctgtattacatatctccaaaaagttaagtagagacatagaagatgggaaaaaaattaaacttctagactactacaatgcctgagatgaaacaggaactggatgggattagcagaagattagatattgcagaagataaataaacttgaaagctaccataaaaactacacaaaatagacagaaaaaaagaattttaaaaaaattaagagaaacagtgggctgtgagacaacttcgagctgcctaatatatatgtta

SEQ ID NO: 403340 - DNA, 166 bp, Homo sapiens
tggtgttgtgtgcatgtatgaatatgtgtatatactgtatatgccccattaatgacagaaatatatatcccagccatatctatcacataagtaatagacaattagaagtgcctatgttttgatcaattattaagtttgtaaagatatattccggaaaaagactttc

SEQ ID NO: 403341 - DNA, 1393 bp, Homo sapiens
cttcacaactatatcttgtcaccataaaaattcctgtgataagactttttatagtaatgtatgaacttaacagttttatcaaattcaagatttttatgagttaagcatttctggaaagatgctaaaatcataagcatgacatgaagatctgcataaaattcaaaatggtcttttttaatggtgatgtattcagcattgtcatttatttgtaccatgttttaatatattttttctaatgtagtttcaacgcctttttaagagcatccactttttaaaaaaatcctttgtcatttcctttaattaaagcctggttagtattgtagagtggcctcatgccctcatgcacgaattgtacatgtctgtccctgtatgtcactgtatagtctaaatgtccttgaaaaatgatttatgcttcattttctcttattgctgataaatcttaaattctgtttagtatttttaaaaagagatcacttaacatgctaattggactcaaaatgcacctagaagagttcgtaaaactagtctcagagtttctaaggtcagttgaattggccaataccacattgcttaattaccctgaaaagcatttctgaggattccttgtttcctaatccttgttaactacataaatttggtttaaagagtcctgctgactttgggggttttattttcttcctttagaaggaggatttgttttggttgaccagtgattagaagttcacattttgcacattaaactcaccatgcagccttcccaaactatacattcctggtcccaagcccgagggtgctaatttagacaaaaatatggttggagccggcacttctgcttaagtgttgcaggtaatacgtagacctaacaggttgagccactgttgcaggtacacagtacatgactgatgtttctgtgattatcacagttgaaatatttcagccaagatgcacattacttcaaagctgctcatccttggttttcctaatttgtatactgaccatgactttactaatttcctggaacttctgatggttctgtcttttatgtagttgacagtccttagatttgccacactcgtcacaagagtgtgtttatatttttttgtgtctgtgtgagcatagatgggcatctttagctcacctgcactcccaccactcgtttccctatgggaaaaggtgattttttgccccccttttaccattacatactgagagtgctgatgtcgggtattgggagtcattcttggtcattaaaacaggatttttttttctgccaattacctgaatgttctacatgaaattgttcttggtttcaatagatatataattatttccatattaactgaccagttttttagttttgaattaaagatatgttgctttagttttcgttgta

SEQ ID NO: 403342 - DNA, 353 bp, Homo sapiens
tggagtttcgactggaaatagagggtagtgttgtgtgtaccacctaccatcttcagctagacactttcaaagagtttgttttgttaattatatcttcttacatggctcattatgcttgttgaaatttgcaagatgctttaaaccaatcctgtccaaaccacagcctgtgggccgcatgtagcccaggatagctttgaatgcagcccaacacaaattcataaactttcttaaaacacgaaattttttttgcaattttttttttccttagctcatcagctatcatagtgttagtgtattttatgtgtggctatggcccaagacaattcttcttccagtgtggcccagggaagcca

SEQ ID NO: 403343 - DNA, 383 bp, Homo sapiens
caggtctttctactgaagaagtggtatttctgtatggaatgtcttttgaaaagagagaccatcacaaatggtgttattaagaatgttgaactgccgggcgcggtggctcacgcctgtaatcccagcactttgggaggccgaggtgggcggatcatgaggtcaggagatcgagaccatcctggctaacacggtgaaaacctgtctctactaaaaatacaaaaaattagccaggtgtgctggcgggtgcctgtagtcccagctgctcaggagcctgaggcaggagaatggcgtgaacccgggaggcggagcttgcagtgagctgagatcgcgccactgcactccagcctgggggacagagcgagaccccgtctcagaaaagaaaa

SEQ ID NO: 403344 - DNA, 405 bp, Homo sapiens
atcccctgtctacctccagaaacaccagagtaatgtagatctttgtggtaggtttccctagagttggccaaggggttttgctgatgtatcaaacagaaaacacccttgttcctctcttttcctctaccagtctgctgatgcccatgcccagtaacagttttatcacatgcagcctcctgggaatgttatgatgcccacatttggaatatgtttactttagggaaatagctcttggaatttccataaataaaattatctaccatgttttactgggatagaggaagtctgaggttctatgggactcaaacttaggcctgagagctggagaatggtggctatgggaagtggcatttcaggtgagagttaaaggaagaataggagtttgtgaggtaaagccaagagagg

SEQ ID NO: 403345 - DNA, 225 bp, Homo sapiens
aatctcttgagcctgggaggtggaggttgcaatgagctgagattgtgccactgtactccagcctgggcgacagggcaagactctgtctcgaaacaaacaaaaaaaccccacaaaaaaccacgtcgttaatatggggcacactcattaagaatttttagtaattcagagaggaattagggtgggattaactgttgggggacatcgtatgagatttgtcgagcaaat

SEQ ID NO: 403346 - DNA, 341 bp, Homo sapiens
cacagaatggagtgatgccgctgagagccaaagcatgaccaaggattgacagccatcatcagaagctcggaagaaacaaggaaggattgattctatgcaatctcagagggagcacgaccttgctgacaccttgatttcagacttctgggccccagaactataagagagtacatttctgttgttgaaagccacctgctttctgacattttgttccagcagctgtaggaaactaccttacctttcatatcttgttcaagaaatcttttgcactatcatacagatatcaccatatattttttctaaaaaaattaaagtttagccttcatggtttgataatgtca

SEQ ID NO: 403347 - DNA, 506 bp, Homo sapiens
tgccgcgggcggctggcccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcagcacagtgaaagtcaaatgtggatgaggatgtcttcccatgatgctgacactcatgaccttctagaaatatcaaatattgcca

SEQ ID NO: 403348 - DNA, 776 bp, Homo sapiens
tgccgcgggcggctggcccagctggaggaagcggcggcggcggccacgatgagtgcgggcgacgcagtgtgcaccggctggctcgttaagtcgccccccgagaggaagctacagcgctacgcctggcgcaagcgctggtttgtcctccggcgaggccgcatgagcggcaaccccgatgtcttggagtactacaggaacaagcactccagcaagcccatccgggtgatagacctcagcgagtgtgcagtgtggaagcatgtgggccccagctttgttcggaaggaatttcagaataatttcgtgttcattgtcaagactacttcccgtacattctacctggtggccaaaactgagcaagaaatgcaggtgtgggtgcacagcatcagtcaggtctgcaaccttggccacctggaggatggtgcaggtaagagcggagttggggctcccatgtgctaaggggtatcccaggactggagggttactgcagaaaaacagttcaagatgccaagcctgcctccttgagggtgttttggcaggctaatttatatcagaactgttcctaccaaatacaatactggaaattgccctcttttacccagtccaaatgtgggaaggcagagtccatgagcacactgagcattgcaggttactttaatggctttaaaaccccttcatgtctttgctctcattcagccacagtgaaagtcaaatgtggatgaggatgtcttcccatgatgctgacactcatgaccttctagaaatatcaaatattgcca

SEQ ID NO: 403349 - DNA, 470 bp, Homo sapiens
aagagagagcatgagggcggaggtgctacacacttttagtcaaccagatcttgtgagaactcaccatcatgagaacagcaccaaagggatggtgccaaccattcatgaagcatctacccccatgatccaatcactttccaccaggttccacctccaactctgaggattacaattgaacatgagatttgggtggggacacagatacaaaccatggggacacagatacaaaccatatcacatgcaccaggctgcatcccaaaacaactaaagaatttctgagggtggaacccaggtatctgtattttcctgagctttcaaaatgcagccaaggttgagaaccgctggtctaattgatcactataatttccctttccatgattaatttaggaaaaggcatgtgacccaatccttaccaagacacaggaagtctcctggaaggctgctgggaaagctttctttacccctttgga

SEQ ID NO: 403350 - DNA, 491 bp, Homo sapiens
gggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactg

SEQ ID NO: 403351 - DNA, 407 bp, Homo sapiens
gaactcctgacctcaggtgattcacctgcctcggcctcccaaagtgctgggattacaggtgtgagccaccgcacctgtccaaaaatcataaatttaacttggatatggaattaatttggccctttctttatttcagtgaaagacgtataaaaaattgcccccttatcaacacaaagggtttctcctgaccattatttccaggtatgcacagtctcctaactatgacaacagaaatcattctgaactccttccatttcccagggagaaaacagaagcaccttgggcagagtgaaaaagaaaccacctggagaggaggccctgcaacatgaacccatctttaggcccaagggcattctgacatctgaaatcaaagtcatgattgcctccatttctagaaaatgttccag

SEQ ID NO: 403352 - DNA, 1190 bp, Homo sapiens
atttagaactaaagattaataactagagatttataaaggcaaaaatgttaatgaattaggaaacagtaaaccatttgaactaatctaaatactgattgcatgaaaatgccaataaaatcaatacatatttttaaaagccagtcaaggataaaagaaaagagggaaactaaaagtgagacattaagtatgagaaaggagataaaactaaagtgtggaggtgatgttaaaaattatattcaggtctgtgctaatcattttggaaatttcagtgagaagtgggcaattttcagtgaatatatcattgtaaatgctttgaggagagacaaaatctgaatagaccctgcaataatgaaaatgtctaggagccctcaagaaatacctggtttaaattgcatttcaggtggctggttatcacaccttgaagtatcaagtaattatgttatctaaattggaccaggtgttagaaaaatatgtgagacttcacaggtggctgcttatgtagcccttataccttaatctgataaaggtagcatatatttaaaaagagagaaaaccagaaggtacaatttagggaaaattaaatacttctatttggccaaagtaagagtacattcaagggaattgtgagaggtaagagtggaaacagaggttggagctgtatttttatgctgtgattgaattacagtgtgtgataaatattgctcttatttgggtagattaccatttaacattttgaattaattggtaattggattaatcttaacttttaaaaaactaatctgagagtggtataaaggatagattacagaatggataaagggtgataaatcagttggctatggcaaaattgcaggaagaaactgaaataggccacagaaaactgaaactgacattttgagtagtatttcagaatcaagatctggattttggcaactgaatagatgcgtaggaatcaaagatgagtatactaaatgaacttaatctatgatttgtctgtcattttattgtgtaccattagtgtgtatgcatgtatgtatgtgccaggtagttaataggctgactgtgtctcttagctccactctgctgcctgggcctttgccatagtgctggagttccctcacttctcttttctgtaaccctattatattactgctgtctctcagctgtgtttcattcctcaagcagaaaga

SEQ ID NO: 403353 - DNA, 371 bp, Homo sapiens
cagaaaacaacttttttttccccttgctataaagaaattagggcaactggcacaaactaagtaaggtctgtgaatgcaataatagtattttgtcaatgttgacttccgattttgataaccgttgttaagagaatatccttattattaggaatatagagtcaagtatttgggggtaaagggcccgcaactctgtaacttaaaaatcaaatggttcagaagaaaaataataaccttaagtatgtgtgtatggaaagacgaacgtaagcccatatggtaaaatgttaactggggaatccgggtgaagggtatgtaagagttctctgcactattctggctactgttctgtaaatatgaagttacttcaaaataaa

SEQ ID NO: 403354 - DNA, 438 bp, Homo sapiens
acatgtatttcatctaacttgtgaagttcacaactatttcaaaaaacagttaagcttgttccaaaaactcactgccatcccaccaaacacacatatggacttgagaataattaggctttcagaaaccactttagtatccaattaattgtagttttcttcagaaagtggtgtaaatctgattatatatagttgcttcatgtagtataaatctgattatacacagttgtttcatatagtatatatctgatgatatacaattgcttcatgtagttcaacttgttactagataatccatgtgtaattgtcacagaaaatcttacgtgtacatttggacaatgtctctatctctgtttctttctctctgtttctctctctctctctcacacacacacacacagtcctttacaattactttgggaaaaaaatcacaaaaaggaa

SEQ ID NO: 403355 - DNA, 308 bp, Homo sapiens
ctaattcccaacatgggagaatcttaataaccaaaattcccagcataagcaccagctgccctcaccacaccagagaaaatccagtagtttggggaggcatggaagaagactacagtataggcaggagccagaggcagagaacgtaagtgtggcttgagtagctcccaagctgcattcccttacacccaaaggaccttcctttaggatattctccttatccagctcctgggttcccagccctcagtaggcctcattccagtgcctcaaaggcagaccaatgcattaagggagtataggaaagaggagag

SEQ ID NO: 403356 - DNA, 778 bp, Homo sapiens
cagctttcaggaagtcagacggtaagagctggagtcaggatccaccaccttgccacagtgtggcttcagtccttctggccaggttctcgcagccttctcctgccctccgatgctcatctcttgtacttgcctctttatcctgtgagcagctctgagctcaaatgggtccccaatggcagagagccacactgctcctctctgaagggcgtagggcctatttttaaatacctgcgctcctttcattgtcttgtcttacaaattctaacttggcagactctctctccccatcatctccagttcccttgaatcactgtccgtgtttcccttccggtcacaactgagctgagggcagcctttcctcccatgctttcccaacctctgagtctacaatgagcagctgggcaacatggaggccatctctggtgctctcctctgaatgcgattcgggtttcagcagatgtccaataaacaaagctcttgctaaaaatgcaaatgcctctcctaaggatcattgtcatttttaaaccacataaatactcagataattatctaagtggccaagtgtgtatgagccaggctcgcagggcagagaggcatcgccctggatcctaagcccccttacagctttccaaaccaaacactgacacacaggaaaatcagcaggaacttggcattctgtttctgataatttgcagcattagcctatgcaaagcccgagataaaaggtgcctgttttactttgaatagaaatcacacaagatatttccaatcaagcaca

SEQ ID NO: 403357 - DNA, 455 bp, Homo sapiens
cagttttcagtgaccaatgaaagggtcatgacttaatgcctccactcttcatttaagacccttttgtttctgaaaccttaaaaatacattttatgatagagtgttttcatttctactttacctttctatcttaacatatagagtatatctcagtattttggggtttatgctattggagagcagaagtgagtcttaatgagtaatagtattcagaattatattatttgggtaagcatatatgactggaagacaagggacggttttacttttatatgtctttgaattactcttggttttcagaatagatgtttgtttaataaagagttatatttcattatgtaactgtagtgtttttactgtactgtaaaaattccccgaagtaatcaccagataagtcttcttttgatgtacattttaaagtatatcatctgcaggttttgcttttctaataaaaa

SEQ ID NO: 403358 - DNA, 408 bp, Homo sapiens
atacttgtcctatataaatccagactttctataaagctcaagtaactaggataatgtgaaattgggatggtgacagacaaatagactacccagagcccagaaacagattttctgtgactgatttgtgggaaaagaggaactcccatttatggtactggaatgatgggttaaccatgaggaaaaaatgaaattgaatttctatcttacacccaaagatttgggtgtcccctgcagatagatgatcacctaggagtagatacacaaaaaacatttcaagatgatttaaagacttaagggtttcacaccatatacaaaaattaactcacaatggatcaaagacctaaatgtaagacctaaaagtgcctgtaaaactcttagaataaaacttagatgtatcttgtcatgaaa

SEQ ID NO: 403359 - DNA, 301 bp, Homo sapiens
gcacttaagtggggttcttccacatttttccattctgaattttttctaattatttgcaattattgatgacgtcatcatcatttttctattttctccatctagagctctaacggtttggatgttggactttctgaatatcacacattgtattagtccattctcacactgctataaataaccacctgagactgggtaatttacgacgaaaagaggtttaatcgactcacagttcctcatggctgaggaggcctcaggaaagttacaatcctggtggaaggtgaaggggaagcaaggcatgtct

SEQ ID NO: 403360 - DNA, 486 bp, Homo sapiens
tacagagaggtcaaaagtccgtctgactcacctgtgctgagtgacttgaatgccatctaatctaacttcaagatcatcaggatacttgccaacaaggtcacagtggactccatggagcaactgccctcaggaggcaacagatggcttcacttgcttattggctgaaggtctgcaaggactcaattcacatatctgatcatacctggagtccagactttctcctgatgcctgacccctttgccattaggtcggctccgtatgactgagttctagccagtgaggtatgggcagaagtgatgtgtaccaattgcgagctcgacttttgaaatcatcccacgtgatcctcctgccatctaccagccatcctttttgatcttgaaggtcttatgcctcagattgtgtaactacaggatgaaggaaggccactcaacccacacttggacatgatgtaagcaagaaataaacttgtaatgtattaagccacta

SEQ ID NO: 403361 - DNA, 365 bp, Homo sapiens
catgattgatgtttaattataaccatatttctgttcataattcttgttaaccctgtgaagatggcttcacttgcttattggctgaaggtctgcaaggactcaattcacatatctgatcatacctggagtccagactttctcctgatgcctggtaagaaccctaggttcaaggatgcatttactgtgtctctgaaattttcctcctaacctcaggattagttctcactcagagctccagtctctactccatgcatttcttatccacactcttttccaggcatcccatttttttacagttcctaaacttgccacactaatccatgcatccatgcctctgccttaaaatgcccctcttctttcccaca

SEQ ID NO: 403362 - DNA, 917 bp, Homo sapiens
acaaatacctaatgcatacggggcttaaaacctagatgaagggttgatgggtgcagcgaaccaccatggcacatgtatacctatgtaacaaacctgcacgttctgcacatgtatcttggaacttaataataattttaaaaagggcttgcttgcatggttatggttgagactacagatattcttcaacacgctcaaatgaggaagatgagggttgaaaacccattgtaggatgctgtggatctaggattcgccacagttccaggagagcttacgctcttgatctaaaccacagttgttctcaacactgactgtgtatcagagtaatgatagaaagcgttgaaaaatatagatttccaggaactgcacaaagacctgctgaatcagggatagggccagaatctgtatatttcaaaatttccttcagcgtttctttatatagccatggttttcaaactgccgctctaaagctagggaaaattatgatagaaaatataaatggtagtgggcccaggaactaggaaaccttgattcaaagtgtttgttctgccactagttcaatgaatggtcttattcaagtcactcctgcctttgtctttcaaatgagagaataagaccacttggtgtctaaagtctttctatctctgacattaccttgagagaaaggtgcatcaaccacaatggttgattttgagaatatctaaactttttcatagagaccaaagtaaataggattattattgcattgtgtaattgtgctcatggttcaagttttaccatgttttagtccctcccagaaaaggaagtagggcataatgcttagaacaggcgatatcagtcctgaaggagaagggatcctacgggttctttcagaaagtttattccccgggttggtggggatcgcattgtgccgacttgcg

SEQ ID NO: 403363 - DNA, 835 bp, Homo sapiens
acaaatacctaatgcatacggggcttaaaacctagatgaagggttgatgggtgcagcgaaccaccatggcacatgtatacctatgtaacaaacctgcacgttctgcacatgtatcttggaacttaataataattttaaaaagggcttgcttgcatggttatggttgagactacagatattcttcaacacgctcaaatgaggaagatgagggttgaaaacccattgtaggatgctgtggatctaggattcgccacagttccaggagagcttacgctcttgatctaaaccacagttgttctcaacactgactgtgtatcagagtaatgatagaaagcgttgaaaaatatagatttccaggaactgcacaaagacctgctgaatcagggatagggccagaatctgtatatttcaaaatttccttcagcgtttctttatatagccatggttttcaaactgccgctctaaagctagggaaaattatgatagaaaatataaatggtagtgggcccaggaactaggaaaccttgattcaaagtgtttgttctgccactagttcaatgaatggtcttattcaagtcactcctgcctttgtctttcaaatgagagaataagaccacttggtgtctaaagtctttctatctctgacattaccttgagagaaaggtgcatcaaccacaatggttgattttgagaatatctaaactttcctgagacagtaaagatctatgcatgttctggcccggtcgtttaccgttagcgccaaagaatggttagccaggattaactttaaggcacggctccacatgatccgtaatgaaccctgtcttgtcccacg

SEQ ID NO: 403364 - DNA, 488 bp, Homo sapiens
ttatgatagaaaatataaatggtagtgggcccaggaactaggaaaccttgattcaaagtgtttgttctgccactagttcaatgaatggtcttattcaagtcactcctgcctttgtctttcaaatgagagaataagaccacttggtgtctaaagtctttctatctctgacattaccttgagagaaaggtgcatcaaccacaatggttgattttgagaatatctaaactttttcatagagaccaaagtaaataggattattattgcattgtgtaattgtgctcatggttcaagttttaccatgttttagtccctcccagaaaaggaagtagggcataatgccatagaaacaaggcaaatataaacaccaactctctgaaaggaaagagaggcagtacctactgggagtttctttttctatgataattgtttttatttcccctctgggttataggttttgggaaaaataatgcacagatattgtgtgtaaa

SEQ ID NO: 403365 - DNA, 1291 bp, Homo sapiens
gctgggattataggctgaaccactgtgccctgccagaaatccctaactcttaaacattttatctgatggccatggcaagtccagtaagccagatctggaagtttggccagcaatttctggctgggaatgccatgggaacctaaagaaagggggcctcaaattccaagtcacatcctttctggctttcttccggacagatttccacaactgttttcctaaaatgaagatctaactcatcatgattttccttgaaaacctcagaggcattcctcacatccgcatcctagagtgtgaagacaaactctaggcttggcatgaaaggcacgtcgctctgtgacccagaggcactaaccacagccccacgccatggctccggggctctgactgtccctccattctctcctcatgtgcattcttcttcatcctatggtgccatagcatggggccacccctgtgacctcaggcagcctggtcacctgccccgctgtgctttgtctcaaagcactttgggctaaaaagtggtaacaagttcctgggggttcagtgactcattcccaaatctggattatgtgcctgccatgcacctggtgctggagctgcatctctgccctgagggtggtcaggaaaggcctctctgtggaggtgacatctgaaggtgacctaaatgacatgaagggtgagcctgccatgtggagttctggggaagagcatccaggccgaggaaacagcgacagagggagccaaagagggagcgtgtagagaggtgagcagggccctgacaaggtagaacagccatgagaaggttcctgggggcttggagcaggacgtgcaagtgagttttaacagtgacctctgacagctgtgcccagactgcagtgtagggccctgaatggaaatgaggagagccatggggaatccagtgcaactgtccaggaaggagagggaggcgtccacactctgaccacggacagcaccagaagcgattggactggagacgtactttgaagggaaagtttgttggacttgcccgtggattcaaggtgttaaggacaacccctgtgttttggccctggctacataggtggcaggagcttccatcatatacacccccaaagagaaaggaccccctgtctaatttggtgttcaccacgtcattgacttactatgtatactggttctcaccctagctgcattttagaatcacccagaaacttttacaaataacagtgttcaacctccagttgttgagagttaatttaaatggtttgaggcaggtccatgcagatttctt

SEQ ID NO: 403366 - DNA, 396 bp, Homo sapiens
agctgtcatcaactgaaatggcaaagacgtgggtaggacaggtctgtgggaggagattaggggttcgtttttggaaatgttaagcttgagaagtctagtagacatccaaaagaaaatgtacatttatcggcctttaatattgaatgtgtctccagtgttagcagagtaactggccctccaaatatatggttggatgaaagaacaagaaaagttgttcaagtattaagtgaaataagtatgagatgaccccattttgttttatgtatatgcatacacacacacacacacacacacacacacacacacatttgtaactcttcttacatattgccagattgctctacagaaaaactgaaccaatctagaattccagcagtgaaagaatgctagacagtc

SEQ ID NO: 403367 - DNA, 464 bp, Homo sapiens
aaactgaagaagaatactttagaacatttgtgccattacttactgtcaggaacaagggaggtggagaaagagcatttaggagggcatttccctttttcccaattaaagattgtcgttgcagactcttgactccagccctaaccctttaaacacataggaagacctgtggctcctggattacagagtgtattgtatctgtgaactgtccatctgtcactcattagtcattctgtttcctcaactgggaggaaactgagagattatctaggtggggggatgaggtggagtagccgacctgaaatattttcacataatgagggttatatttatcatgactcttatttggagggaaaaaaaatgatcaaacctcaaacctttgaaaatagaattagctgggtatacgaatcccaaacacatcctaaaacaaagaaactactatttatgagttaaagaatggtgaaaat

SEQ ID NO: 403368 - DNA, 571 bp, Homo sapiens
tgataaaagaacgacagtaagaggcaagtacgcattccatgacttagtgtaacagcctccctctgaaccctactccagcagctcaacctgcctagtattctagtctaattcctctaataaacacctaattccgcaatactcatagtggttctatttccctgtctgaaccctgaatttctgctacaggaagtggttcaaagaagtccttaaagatatgaacctgaagttgcttctctgatttgattgaaggtattaatgaccagtttccaatggtaaaggggctactagtagtccacggcatgtagtggcaaaatatttaaaatcatcatctgcagacaaggacctacagaagacaaagccttgggtaactagctagttgatgccatagaagattttagtaaaaataagttgtataatgggttaattagttgtttctaggtacactggataattcttttctcaggaaaagaaaatgatgagctcggagttttaaaagcactactcaaatctgggtaagggggccagaaatctataaatggcttcatagaaagccttatatcatgtgggtaca

SEQ ID NO: 403369 - DNA, 394 bp, Homo sapiens
ggcaggcacctgtaatcccagccatttgagaggctgaggcaggagaatcgcttgaacgcaggaggtggaggttgcaatgagccgagatcgcaccaccgcactccaagcatgggcgacagagcaagactctgcctcaaaaaaaacaaaacaaaactcattcctccaactccaactcatttctcctaaggataacattaattatactgatgaaataaaagagcagtgtaagaatctttccacctaccatgtatatcaccaacttgtcattttcatcctttttcaatttatttttaaaaagtggtttcagctgggcatagtggctcacatctgtaatcctaatactttgggaggctgaggtgggaggatcacttgaagccagaacttgagaccagcc

SEQ ID NO: 403370 - DNA, 396 bp, Homo sapiens
caggcactgtagagggggatacacaggggaggcctttgagaagacaaggccccgggacggagcctttaaaagtccaccattgagtgggtggccggccatagagagacgccgtcagaaaagggggagggccaggcgcagtggctcacacctgtaatcccagtgctttgggacgccaaggcgggaagatcacttgggcccgggagttcaagaccagcctgggcaacatagcaagaccccatctctttaacaaacaaacaaaaaaagaccaggcgcggttgggctcatacctgtaacctcagcactttgggagtcaaggcgttcagatccaggagttcttggatccaggagttcaagaccagcctgggcaacagagcaagaacccacctctttaaaaaa

SEQ ID NO: 403371 - DNA, 292 bp, Homo sapiens
aagaggagttacatcatcaaaaaaggaatgcttaattttgggacatagaaaaatggagttaggcagaattgccatgctatttaaaaactttctaggtgcaaaggtaccttgtcccaaggactcgattacctggccctcatgcaggcatggccttgctctaaagatgaattcagaccaggtacagtggcttgcacctgtaatcctagcactttttgaggctgaggcgggaggattgcttgagcccaggagtttgagaccggcctgggaaacacagggacatcccatctctaca

SEQ ID NO: 403372 - DNA, 507 bp, Homo sapiens
gcttttttttaagagactgagtcttgctctgttgccaaggttgtggaatgcagtggtatgatcatagctcactgtaacctctaactcctgggctcaagtgatcctccagcctcagccccctgagtagctgggactacaggcacatgcccaccatacccacctatgtataatttttgtatatgatgtgcagtaggactcaaattttattttttacccccaagtggatatccagttgtccccgtggcatttattgaaaagttcatctttccccattatctgcattgcttacttctgttgtaaattaaatcaagtaaatatttatatatttatttttaaaattaaaacaatttttttttgagatggagtcttgctctgttgcccaggctggagtgcagtggtgcgatcctggctcactgcaacctctgcctcccaggttcaagtgattctcctgcctcagcctcctgagtagctgggattacaggcacctgccaccacgcccagctaaat

SEQ ID NO: 403373 - DNA, 177 bp, Homo sapiens
ggtattgtacaaagcatatagtaagtaccaaataactgttagctgctattaataatccattatcataatcctaataatatgaacactcagggctgccttagaggaaaagaggtttacagaagaacaacttgctgcctgaggtgcttgtgtagagggatgattgttaccatgagtttc

SEQ ID NO: 403374 - DNA, 450 bp, Homo sapiens
atgatttcatgtaattcatgattacctaacacataattcctttattcccgtttgccaatataaatgacttgtctgagatctgacagctagcaagttagggaaataaagattgaattttgatcccttgaacatatttctttattggtcatccctttacttagccaatattgagtgcctgctatgtgccagccactgttccagtgctggacacatacagatatataggacttggtgcttcttcctgtggagctccctctctaaaagaaaagatgggccagcaactagctgctgcaatgccatctggtcagagctgcagctggcagcctctagtcccagccattggggaggctgaagtgggaagattgcttgagcccgggaggtggaagttgcagtgagccatgatcaaactactgcactccagcctgggcaacagaatgagacccagtctcc

SEQ ID NO: 403375 - DNA, 434 bp, Homo sapiens
ctcccagtctttaccaagatgctctgtgtgtatgttgggggcaactttgccttagcacttcacttgtacagagcttgaagttcagccataggtgagaactttggcctttcttaggtgttttctgagcatgtgcacagccttgggaatgcctatcatcctgtgcatatgcatagccttttagattcccaggtatttgttggaggttttctaagctccatatggacatctcattccccagcatttacttttaagctttttggttagcttaatgttcaccacaactgttacctattaccataggcagctgtaaagttaatcatttgtctctaattatttttgacaaataccccaaggaaaaagtttttcacactgagcacactcttgaatcatgcctaataaaaaaagccttgcaagtggggtctttcaaggaacca

SEQ ID NO: 403376 - DNA, 460 bp, Homo sapiens
tagaaaacatccatgtgttcccttgagctgtgatgaactttgttttctggaagagagaaacagtggggaagtgaagtttctggtgcaggtaactcacaggtcccgttggggctgttaagaggcctcggagaaggcattttttgttttgtttgctttgctttttagcttggattaatgcaatgttgagagaaggagcaaattgcagagttatgatttaagtcatttaagtgcatttaaaaaacacaacatacacataagtagcaaaagtgaaaacagtgaaacaccgatggctgtgtaccaacttccctgtaattgttgtctggggagagggaagaaggacagtgccctcggaggagcacggagcaggtctcttgtagccgtgttttattccttataataaaaagatctctcctctgagaggctggagacaaaaataaaacataaaatacaataaaaagtt

SEQ ID NO: 403377 - DNA, 363 bp, Homo sapiens
cctatattctttccagcagtgttgaaagaggctcagtgtctctcttatcttgaaaaccctcccctcctctaagatctctcagactactgccccttctacttgtctcatcaaagctaacttgctttctccagtttaactcccaggtgttcccagccctctggcttcatgctcactgaaattgctcacctccttaaaactaaccccaacactggctgggtgaagtggctcacgcctgtaatccgagcactttgggaggcagaggcagatggatcacttgaggtcgggagttcgagaccagcctgaccaacatggtgaaaccctgtctctactaaaaataaaaaattatccggacgtggtggtgca

SEQ ID NO: 403378 - DNA, 246 bp, Homo sapiens
ttaaataaactttttcacatttagaagcaatttatgctcacttagaaaaatttgaaatacacaagatggcaaagaagatcatgaaaatgttccctaattcaactgtctcatggcaatgcttactccagaagtttacatatagaagtggttgaatgtaaagtttcttttaaggcaacttatgttgtttcactttgggagaccacgagttcaagaccaatctgggcaacatagtgagaccttgtctcc

SEQ ID NO: 403379 - DNA, 766 bp, Homo sapiens
  misc_feature (532)..(532): n is a, c, g, or t
gggatagagacttttacctccattttacagaggaagaaactgagccaccaagaggttaggcaacttgctcaaagtcacatggcttgaacccaggcacaactcagttctcccagcttgggccccactgttccctcagcccgccctgcacagacttgccagcacagaacatgttgtcagtgatgcggatccgggtggagtccttgcagaccggccgctccacaatgggcaggttcaccacctgcaggacactgggctgccccttaccaacgttggctgtccacgtctccttcaggttgccccagcctgtcacccgccccttgtatccagcctggagcaagctttggggaaggaagaagggcctagtgagagccaacccccacaggagccgcctggccccaacgccatttcttagagaccagaatctaaaacgccagagctggctgggcacagacgttcacgcctgtggtctcggcactttgggaggccgaggcgggtgaatcacttgaggtcaggggttcgagaccaacctggnccgacacggtgaaacccagccctagatctctactttttatatttactttttatccctattaacaactacagtgcctggcatatagaagtcactcagtgaacagtggtaactgattatatgggtatttagctacaaccagactgcaaaaatactttctttttttaaggcagtatcagtttggttcaaaggaagatagttgttctgctgctgcactatttctccaacttttatcat

SEQ ID NO: 403380 - DNA, 269 bp, Homo sapiens
cccaccccagcctcccaaagtgctgggattacagatatgagccatcacacccagccctagatctctactttttatatttactttttatccctattaacaactacagtgcctggcatatagaagtcactcagtgaacagtggtaactgattatatgggtatttagctacaaccagactgcaaaaatactttctttttttaaggcagtatcagtttggttcaaaggaagatagttgttctgctgctgcactatttctccaacttttatcat

SEQ ID NO: 403381 - DNA, 353 bp, Homo sapiens
cccagcccagtggctcatatctgtaaccccagttctttgggaagttgaggcaggaggattgcttgaggcctgggaaacaaagtgaggactcatctctacaaaaaatttaaaaattagtccagggaaagcagagtggtggcacacacctatagtcccagctacttggaaggctgaggcaggaggacaggagtttgagcttacaatgagctatgatcacaccactgcactccagcctcggtgacagagtgagattctgtctcaaaaaaaagaattctattttgattttccaattaaatgtaaagatacacttgaatgtactggcttgtcagtagttataatgtatgtagtagccc

SEQ ID NO: 403382 - DNA, 298 bp, Homo sapiens
ccccattcagttcctctctaggcaccagctaggaatgtggctccagaaactaggaataagccgccttccactgacgtcctcagaaacaccctttatgtgatcacttatgttttattggtcatcaccaggcatggtgaccagcacagggaacacccatgaggagtaaaaaccacctttcatagcctttcataggattgtggtgaagattaaacaaggtaccactccgaaaggcccttaagtccctgtgcttcctacaaaaggatgtctcaataaatttttgtctcaattaattctggca

SEQ ID NO: 403383 - DNA, 562 bp, Homo sapiens
gaacagtagggaaaaaggtgcttctgatgatctagatgacttgaacttctttaatcaaaagaaaagaaaagaaaaaaacaaaaaagatgtttgatactgatgaagctgaagaaggtgtaaaggatcttaagattgaaaaaatattcaagaaccagctgaaccagagtatgaccttaatattatgcttggcaataaaaagaagaaaaagaagaatgtcaagttcccagatgaggatgaaatactagagaaagacaaagttctagaagatgaagacagcaaaaaagatgacagtatctcattcaataatcatacaggccctgctagggcagtctcaaatacacataaggagctactgaagcgagtgtgcaacatcacgagggaaaagaatccagatgtggttgctgaaaaggaaatctgtcatcaaacctctacaggtcatttgagtaggaaccaagaaaacttattttgtcaactttacagatatttgtaaactattacatcatcagcccaaacatcttgcatttttgttggctgaactgggtacaagtggttctatagatgg

SEQ ID NO: 403384 - DNA, 158 bp, Homo sapiens
cgaggttacaaaaaattttataaactgatagcaccccacctgccatcccattccctagaagcccagttacttgtcataacccagtgaacacattttagctaagtgttcattttcataaatttggaagaattcacttctgtcccttctgtcgtcttctc

SEQ ID NO: 403385 - DNA, 325 bp, Homo sapiens
ggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaa

SEQ ID NO: 403386 - DNA, 351 bp, Homo sapiens
tatgagaaatatcatttcaggggccctagaggatgctggttgctggtgtgatgatttaagcacatcatttgtaattcccctctgtggtcagcctagtctgagaatgtgctgttgggagactagggtgcttattaggatctcttttctgtgccctgccatgactctggcaactcagatggctcagagaggggtttactttattactgattattaaattacattcacagtttattattgttacaggggcttgacagtagtgagtcagcttttggagcgaagtgtgggctcttagcaagatggcatttcgagcactcttggatgcccttgtcaggctttccccttggaactcac

SEQ ID NO: 403387 - DNA, 483 bp, Homo sapiens
agacacaggagcttgggcctttctggccctggttggccattccgaaaggacaaagtagactgtcggccattctctgcccaccagtgtgccataatgaggttgggcagctcagccctagagagatgtttgcctgtatgcatgaattcattaagaatgcccatcacaaggctgagtgcatgcagtggctcacacctatgatcccagcactctgggaggccaaagtgggaggatcacttgaggcccaaagttcaagaccagcctgggcaacatagtaagacccttgtctctacaaaaataacaaatagaactagccagggactgtggcacatacctgtagtcctaactactcgggaggctgaggcaggaggatttcttgagcacagggcccctgggtttgaggcttcagtgaacgcagtgctatgtgatcacgccactgtactctagcctggacaacagagtgagaccctgcctcttcaaaaaaaa

SEQ ID NO: 403388 - DNA, 712 bp, Homo sapiens
ggagagccaataaagatacgacagatctggcaggagaacaagatccagcccaggtgatggggtgtgaggcttggtcttagctacaggagacgctggtctgaaaagaaggcaacgcaaggaagagaacagagccaaggcacctgcagcgagccagagccagagccctgacatcacaaatgctttaattggttccatttattgtttaatccacttgaaattgaatttctgtcatccccgactggaagtgtactgacctgcatactacctgtgtttcctcacagcaggctgaaaagctgtgccaatattgagctcatccagaattagacgaagtttgtattctttttattacttcctttaaccctgaatcagggtccagaagcattttgttgaccattaactcttctctgtgaataaagcagcatgaggaacaacctcttttattcacagagcaaagctcttcgctgctcagccacagcggcttcaactctggcacgggtcctgaagtgccatttctagcacatgactcacaaagtaaataatctgtaaatgaaaagcctcttatcatactttggcacgaaaaacaaagcgacaagccaggcagcatttttccctcatatttgaaccccacatgcaccaagggctgttttatgccttgcacatgaggagtttggtttgctcaaaagcaaagtattggctaacatgtgtgtgcact

SEQ ID NO: 403389 - DNA, 657 bp, Homo sapiens
ggagagccaataaagatacgacagatctggcaggagaacaagatccagcccaggtgatggggtgtgaggcttggtcttagctacaggagacgctggtctgaaaagaaggcaacgcaaggaagagaacagagccaaggcacctgcagcgagccagagccagagccctgacatcacaaatgctttaattggttccatttattgtttaatccacttgaaattgaatttctgtcatccccgactggaagtgtactgacctgcatactacctgtgtttcctcacagcaggctgaaaagctgtgccaatattgagctcatccagaattagacgaagtttgtattctttttattacttcctttaaccctgaatcagggtccagaagcattttgttgaccattaactcttctctgtgaataaagcagcatgaggaacaacctcttttattcacagagcaaagctcttcgctgctcagccacagcggcttcaactctggcacgggtcctgaagtgccatttctagcacatgactcacaaagtaaataatctgtaaatgaaaagcctcttatcatactttggcacgaaccaagggctgttttatgccttgcacatgaggagtttggtttgctcaaaagcaaagtattggctaacatgtgtgtgcact

SEQ ID NO: 403390 - DNA, 805 bp, Homo sapiens
gaattttcaaatctctttaattgtgcttccttgtttcttaacagttcctttttcacttaatgtctctcctctcacattttactacaagcactaaggggacccaagctgcaccttcagtgctttgcttagaaatctcctaaataaacagtttcatcactctcaagttctgcctttcagaaaacactagaacagttcagagaagttctttgccactttataacaagaaccaccttttttttttccagttctaataacatgtacctcattgccatctgagaccttgccagagtggcctttaatatccatatctctagcatgtacctcaaaactcttttagcctctacccatcacccagttccaaagctgccttcacattttgaggtatttgttacagcagcatcccccttctgggtaccaaaatctcaatctgcttggtctgccataacaaaaatccgtagactgggcagctcaaacaacagaaatttatttctcacagtcctggaagctgtaagtctaaaatcagggtccaacagcgttcagttcctggcttgtagatggttgccctctcactgtgttctcacatgaccttttctcagtgcataggtgtggagagaaattggattgggaccccacctttaaggtctcttttaaccttaattacttcctcagaacctatctccaaatatagtcacattgagggttagggtgtcaacaatgaattggggtcgtggggacatagttcataacagttttctctcttcagattgagcattttcttttttttgtttgtttgtttgagagggag

SEQ ID NO: 403391 - DNA, 546 bp, Homo sapiens
atcctttttacatagaggctttttttttccaactaccttttttgttaatagtcttacagataggttttagttctgcattgttcaagtgtacagaagtttcatttcttttaaatgatggtatgatattacagtttttcctaaatttatttaactgtggaaccctttttgtctactccttttaacaccaaaggcatggttatatgtagcactatttaaaaaattctagtctagattaatggacagaataacagaccagttggaaggggctgcttgctgatatgaaaggaaagaacttttgctactttgtgttattttcctgattgaaatggtaaaacatttctcaaatacacaggtttaataaattggattcaaattagtcacttctgtgacttcttaatcatcagctttaaatagatttgattttggtagccatcttttggttttgttttggctaaaataactcattaaaaatcagtgatcagtgtatagaacactgccctccaattgaactttctttagtattggaaatgttctatatttgtgttg

SEQ ID NO: 403392 - DNA, 361 bp, Homo sapiens
ttctgttaatattgtgtattagactaatagattttctgttcccaaaccaacattgctttcttgggataattcttatttggtaatgatttatttttttcatattgcagattcatttgccagccagtgtcttgttaaggatttttctgtctatgtttatgaggaatatttgtcagtagttttctgcttttgtgatgtcttctacattttgtatcagaataatgctggactgatataatgagctgtaaagtgtctcttcttcctgaatgaatctgtaaagaattcatattatttctcctttcagtatataatggaaattgccaataaagtcatctgctcttgggcatttttttaaatttaatta

SEQ ID NO: 403393 - DNA, 596 bp, Homo sapiens
atatatacatatatatatatatagagagagagagagactatatatatgtgtgtgtgtatatatatatatatagagagagagagacagagagagagtaaagatctcatttcctccacaaatgttaaaaacattattctgattttaaaaaaagaatgaatttttaaaatttacaaatttctgaaatggacaaaaatatcctaggccttcttcctcaaaaaataataaataagaataataagaaattgcactggtatctgaaaaagcaacttaaagctataaaaattaaaatagcatgttatgccatgaaagagacaaatgagatagattcaagtttcaaaataacaattgttattattatgatacaattatattaattttgtacctataatttaaataaaataataataaataagaaaaatcactgaataaaggtaataatttaaataatttaaaatcttaaaataatgattatatgtataataaaactgtaaatttacaattatagagctataaacaattttatagttgtaatattttgtaactaatgaaacattatattttaatgattttattattgttgtaattaatataaagaa

SEQ ID NO: 403394 - DNA, 546 bp, Homo sapiens
cttgaaaacttcattctaaatttctaatccacccacacacgcactctgtaccctggctaactatgtcaaagctatttagtcaatgccctaaccaatgtggtctagtttatgaccagctttctgtcctccagacagacagatgctacaataaaatgtgtcacttaacgtaccttcctagttggctcactacaaattcatgtcatcaaacttcagttagacctccactggttctcaaacatctggtgactcagttctgtctgatttctccccacagagactcctgcaaaactacctatttcttcagatccaaacccaattcctgtctcctcaccctctgcaaatgcatttcattttaaaatggtcaaagccatctgaattaagtccccaaaacacctctcgcttaaaaaaatattctatatatccccttttactgaagattaaaagtagcctctcctatttaggaatagtcactcaacttgcacactgaatcacctttcttccatctctcactcccaaccccctctatgcagtgttcccctaactacc

SEQ ID NO: 403395 - DNA, 345 bp, Homo sapiens
cagattgcagaagaaggtgacggattcagttccattttagactggttggctttgaagtgactgagggatatctatgtggaattgagtgcacacacccagagcccaggatagagacaagtggtggggctggggattttgaaattagggcaagtagggggcacaggggctttaatgagctccccttgaaagaatgtttaacgcgaccaaagagaagctgatgacggagcgctgagaaccgtgcacgctggggcctgagtccacaaaagagatcaggagaaacagccacgggtagcacagccaggagagaggttgctcagaaacccaggtagaatgggggatagtcca

SEQ ID NO: 403396 - DNA, 562 bp, Homo sapiens
tcagtcactgtgcctgaagcagaaaatcctagagacagtcttgtgctgcctccaacccagtcctcttcagattcctcacccccggaggtgtctggcccttcctcatcccaaatgagcatgaaaactcgccgactcagctctgcctcaacaggaaagcccccactctctgtggaggatgattttgagaaactaacatgggagatttcaggaggcaaattggaagctgagattgacctggatcctgggaaagatgaagatgaccttccgcttgagctatgagaaatgattgatagctgaaggtggtagtgaggacactttaaaaaaaaatcgccaaaaaactggacttagtttcatctattgtaacatttacctgagatgatcatttctttagtctagaatttgccccaaatcagaagtatacctctgaattatctgtatgtgtcctggattccttggggtcagatttttaaagttactttataaccattttgtccatttgatgccattgtttatcatcttttgagaaaaaagttctgtcatacccttctctccacaaaaaaga

SEQ ID NO: 403397 - DNA, 508 bp, Homo sapiens
aggcagtcttgtcccattctgacaaattgttatagaagagtggtgggggtgaagaggtgacggggtaaggggcagccttagctccaggactatttctgtcacctgtaggctgaagatacaaggccagtgcctttgggagctcagtttcccatctataaagcagatatcagattttgcacccataagtgcatgtgggaaagtgcttgctgctgctgaatatttgcttgactagcctgagtcagacctcatagcctgcccacggatgagctcagccctccgtttgtttgtttccaaggagcctctcatggcaccagcctttggttcccattcatccccattcccgggtgtgatccggctcccctggcaagagttgtggtcttaccatgctgcccaggctggtctaaaactcctgggctcaagcgatccgcccatcccagcctcgccaagggctgggattataggcaggaggcagtattacaaggcaactgagagcaatgtcattggagta

SEQ ID NO: 403398 - DNA, 917 bp, Homo sapiens
aggcagtcttgtcccattctgacaaattgttatagaagagtggtgggggtgaagaggtgacggggtaaggggcagccttagctccaggactatttctgtcacctgtaggctgaagatacaaggccagtgcctttgggagctcagtttcccatctataaagcagatatcagattttgcacccataagtgcatgtgggaaagtgcttgctgctgctgaatatttgcttgactagcctgagtcagacctcatagcctgcccacggatgagctcagccctccgtttgtttgtttccaaggagcctctcatggcaccagcctttggttcccattcatccccattcccgggtgtgatccggctcccctggcaagagttgtgtcagggactggggctcaagccagcctcttcacgtccccgaatcacagcagaaagttgggaaggaaactctggagtcctggcctttgccctagtcacccagggtcatggtgagcgtcagggggttgtgcttcacagatgccatgtgagcagcggacaggatgctgagctgaggaacacaagccctgccccactctgctgtgaatttccttggacaagctgcttcagtattgtgggtctctatggcctatcacctcctctacccacaaacagggactggagagggtgacatgcaggacacttctactggaaggtctagaacaaataaatcatgccttctcactgcctttgtaaaagtggaatcttaggaggtcatattcttactatattaaatttttttgatagagatgtggtcttaccatgctgcccaggctggtctaaaactcctgggctcaagcgatccgcccatcccagcctcgccaagggctgggattataggcaggaggcagtattacaaggcaactgagagcaatgtcattggagta

SEQ ID NO: 403399 - DNA, 159 bp, Homo sapiens
tttaatagcaatagccaaaaaagtagaaacaacccaaatgcccatcaacaggcgaatgcatacataaataatggaatactttaagaatgaaatactcaactacaaaaaggaacaaactattgttgcaggccaaccacgtggatgaatctccaaaccatt

SEQ ID NO: 403400 - DNA, 523 bp, Homo sapiens
tgcccagccctgcgctccagcgggtgctgtctcatagaggacacacggtgccctctccttcacctgcaactcttggcaatttggccctagccagattttgaatgtttgagagcaggagctatgagtaaaggaataagtgaataaataaattgagcagggatctgctcatttggccacaaaaagtgctgttagagggagtagtgtccattgtcagtgcccagcactgagtaggcaccttacaaatgtagacatccttccctttttgacacggggaaacctaaagctaaatgtaacattcagttgcagtaattccaggaatcattacaccctctgcacccagtttcctttttattagcttttacttatttctcttttgatgatcttattggatatgtgcaatttaagataaaatgccccccagatttccttggaagtagacatgctataagaatctagtgaagaataataaattgtggtaatatgtgttgtgctattttttcaactattaaaacaatttaaaaac

SEQ ID NO: 403401 - DNA, 486 bp, Homo sapiens
cacaagttgtaggctcgaagcacggttcactcacatagaaacggaattccatatgtatgtcttgtatgtgaagtctattatcctcgttcgtgggggtatagggtgagatttgtttgtgagtgaaggggggtaatctcataacttactcaagagaaaatggaaagtaactgttgtttattttagaattttgatctgcactgagtgctgtgtttttgaacacggatattataacagctaattattgaaaaagtttagtattcaagtaacaaacctatgatggaatctgtttttttccatctattactattcattgtacctattttatgcatttttatgcatttcaaatgatttttatttggggtcctaaacttttggaggttttatttcttagttatttccatcttttttgtttactctgcaaattagagtcttcaaaacaaaagtgattcttttaggccatggaagtggtaaaaaaaaaaaaaaaag

SEQ ID NO: 403402 - DNA, 425 bp, Homo sapiens
tccccgcccggggcggggcaccggggtggcgcagggggcgggggagggagcccggggccgcgggaggcgggctccaaggagggaggacggttgccctggctgtttacgtgcaggtgaattcctaccgggcgcgggatggccaagggcctgggaaaagtgggctgtgggggcggggtggcggatgagaccgcgcgtggtggggacagccgccactgacggggagggagatccggacagaccggtgtggttggaggcctgcgtgtagagcgagacccaagatcaaggaaattgaggaggatatcgatgaaagcgttgggtcaatccgcttaacactttgtctttttgcccctttcctttcctgttctctcatccctcctttgttttctctattcgctgacgcaaaataaaatattctaaaacgtgta

SEQ ID NO: 403403 - DNA, 814 bp, Homo sapiens
tctcccagtgcatagatttttctttcaccctcttaacaggcatcttttccagaagaaaagtattaattttgatgagacccaatttctgaatttttacctttattgttcatgcttttggtgtaaagtctaagaactccttgcctgaagttcaatcctaaagattttcttgtttttttcttaagaaaaaaggtatagttttaagttttacatttaaatatgattcattttgagtttaatttttgtattaggagtgaaatgtggattgaatttaattcttttccctgtgattgtccaattattccactatcatttgttgaaaaaaattattctttccttattgaattgatttttttacctttgtcaaaaattatttgggcatatttatgtgagtctgttcctagattctctattcttttccattgatctgtatatctgtttctctgccaatatcatactctcttgattactgtagctatatagtaatctttaatattgggtagagtgattcatttcactttattctctttttcaaagttattttagctaatctagtggctgtgcctttccataaaacttaaaaataagcctgtctatatctacagaaaatccttgttgggattttgagagttatgttaagcctatagagcaaattgtgggagaaccgatatcttttctatgttaagtccattcatgaacatggtatgattctccatttgttagaggctttttaaaatttatttcatcagcattttctaatgttcagccttcaaatcctggtgttttattacatttatacctgattatttcatttaat

SEQ ID NO: 403404 - DNA, 597 bp, Homo sapiens
ccactgcgcctggcccatttgtcttgttcttgaagcttccagtccagcaggccccaccgcatatccagtgctgcagagtgcagggtttgctctgcctgtcagaggagccagggcacagcaagggcactgcagttgggagtccactgggcgtcagtcactgcccccacccccacatcagccaaggtcggtctccgctggccttgcaccacgcacagagcactggctcatgccaagaagcagaattcaaactttgatgttgccgccaactagttttgtgatcctgggtaagtaagtggctttgaatctccaaatcctagaagaatgaccagagagtctgccacgggccagtccctgggctgcatgttgtaatggtatcattgtgtttcatgctccctcaagcctgttgctttgttttaaaggtgaggaactgaggcttgcagtttttgtgcagtcatggcaagttcagtggcaaagccaacgtcaagtttcagggccgcagagcctcttctgtactgcctgggtggcagtgctgcagggacccactctatcgctgctttcacattgcttttccctttgtaagcagcacaacccaactgt

SEQ ID NO: 403405 - DNA, 611 bp, Homo sapiens
cagtttaaggaattccttgacagaatgctagatacgaaatgtgacatttgaatttttaaaacgcttttctggttattatcacttcgtttgtgttctcaattagcagggagaacaaccttttagctgcagaatctaaggtggtgttctaggctatcagactgtaaaatagttaattcttaagttgttgagaagttgaaaataaattcatgtcttcttcttgttaagtttgctttaatgtgtttctggcacctaataggatttgatttgcttttagttctataactttgtgctactatacaattaataaaaaatggcatgattgttgtagaatttgggtatttacttttttgcatgccatattcattctacctggtttgaaaaagttacagaatgccgtatacgtcacagttaaagtgtttgatgtaaaagtaaaaattaagaaccaagaaagaatcttctaggttgcattattaacgcttaaggcaaaaatgactatgacaaatggaaacctatttcaaattttgaaaggattttcaacttttgaaaacattggtagcagtgttatattccagcaatacttccttgcgatttttacgttgaacctgaacctt

SEQ ID NO: 403406 - DNA, 391 bp, Homo sapiens
gtcgctgagggtggagctgaggcttggatcctggaccacctccctgcacccctttccaggtggaagagtggggatcccaggcagggatggagggtgaggatccgtgaggagctatggggtgctgaacagaggacctgaatttaagtgaacacgcaggcttccaggcaaggtcaggcaccgtgcacacagtggcgaggagtgtagccaccacctctccgaaatcagctccaaacaggccctccaggtagacagcagtcctggggccatgtcaccaaagccagtgggaactgttccacctgctcactctgggtttcttatcccagatctcaaaatctccagcacaaccccaaaggtccagtgtttccattaaaatgtgggtctcaatgtgatt

SEQ ID NO: 403407 - DNA, 510 bp, Homo sapiens
taaaacttccagaagaaaacattggataaaaactgtgtggtcttgggttaggcaaaagtgtcacagatacacaccaaaattataatccataaacaaaaagtggtaagttgtacttcatcaaaatttaaaatgtctgcttttcaaaaaacattattaggacaatgaaaagacaagtcacatacttgaattgggtattaaaaatacaaagcaaataaaggacttacccagaatatataataaatttttataactcaataataagacaaattaatacaaaaattgggcaaagaaatgttcaagaatcaattcttatgaatgaccaccacctatcttcacctgtcagtgtcaatatcatcatttctaaattaattattgtggttttcttgtggcaactgcttctggggaggcctcaggaagcttcctatcatggtggaaggcaccaaccaaccaactaaacaagcaaaattccaaacaaaaagatccacctcaaacccatgtcttgtatcttac

SEQ ID NO: 403408 - DNA, 327 bp, Homo sapiens
ctctgggcagcgtctgctctggtccttgtaaaaacagccaaccaatggccagcgaccacaagagaaaatacatatcctatctcctacttcttccataataagctctggggtcaaaaagctcagagttcaaatcctcactccgccactccctctgagtgggatccccagctagtttcttggacttgtcaagctttagtgtctgtaaaacgtggagaaacgcagacttcgcaagcttgctgtaaagattcaatggggagatagaacggggacgagcacaggttgaccagcattccgagccgtctggccaggcatcgccagcaccttctc

SEQ ID NO: 403409 - DNA, 383 bp, Homo sapiens
agtgatgtctgatacaaagaagataacaggacaataaatacacgaacttaaatctttttgcctatttcaggcaaaaaagtttaatgggtatataggtatacaaaaaaaaaaaccattttttgtaacattttaagaaataagagtttggaaatctttggaaatccaaggtcctaggtctccaatttctttaaggggggaaaaactcacgattaggactaaatggagacgtcactctcttgcactgatagtgaaatattaactgccagaaagtacctccagtccccattcatgttgtatgacagcagcctttgtactgaggcctaatgaaaaatctcaacagaggaagtgactgtatatacctacaacgtactattttcaaagtc

SEQ ID NO: 403410 - DNA, 491 bp, Homo sapiens
gcacgagctggcttccaggctgttgaactattctgcatgtagctatgctgacaagtaatttcatttgacaggacctgcgagcccatgtctgttctgctaagaaaggattgttaacctttccttgactgcaatagtggtttgcaactgcttgtttggccctcatctccctatctaccaagccttgattgctcctgtatttaaaagcacattaaacacaccatggcccgggggcagtggctcatggctgtaatctcagcactttgggaggctgaggcgggtggatcacttgaggtcaggagttcaacaccagcctggccaacatggtgaaaccccatctctactaaaaatatgaaaaaaaattagccaggtgtggacatgcctgtggtcccagctactcaggaggctgaggcagaagaatcgcttgaacctgggaggcggaggttgcagtgagctgagatcgtggcactgtactccagcctgggcaacagagt

SEQ ID NO: 403411 - DNA, 449 bp, Homo sapiens
aagagagagagaactgagaagatgatttgttcagcctcagggatgaattatgattcaaggctctcctcttcctctttgccagtcttgggttgggcttttgaccagttctggccagtgagatagaaagggatgtctgctgcttggagctttgcagaaagattttcctccctgataggggagatgtacataaggaagaaggtattttttccctctatctgcttccttcttgcttgtgactatcttgagagatcattaacttgaacacatgacagttatcttgcacctaggtggggagacattgctaatacatccagagtatgtctgacagaaaggcagacatagcttgggtccctaatgatgtactgaactgctgaaccaacactggaatcagcttaattcagagctcctgttagaattgacaattaaatgtctttgttatttaagccaaa

SEQ ID NO: 403412 - DNA, 384 bp, Homo sapiens
actttgcaaagccaaagccagcagatcccttgagcccaggagttcaagaccagccagttcaaaaccctatctcttgaaaaaatacaaaattagcaggtgtggtggcacacacctgtagtcctagctagttggtaggttgaggtgggtgcaacacttaagcctaggagatggaggttgcagtgagccaagattgcgccactgcactccagcctgggtgacagagtgagactccatcacacacacacacacacacacacacacacacaaaagagacatactctttctagcttcaacttggatctactgctactgccagcattcccgagttaatcttggatcattgactgcttttgggctcttttggcaaccctaaacaaaaaaagc

SEQ ID NO: 403413 - DNA, 381 bp, Homo sapiens
ttccaggttgagttcagtattaattttttatttttagagacagggtctgaccatgttgcccacactggagtacagtgggtatttggctgttcacaggtgcaattgtagtgcattacagccttgaattcctgggctcaagcaagcctccttagtaggtgggactattggcatgcgccactgtgcctaggcatttatatcactacatttaagatgcgggttaccacttagccatgcctacagtggtatttctgaatcttagtaaaccttagttttgaaagaagttttagatagcatttaccattttaaaataaatgatacagttcctgctgattttgcccaggctaaactcagatgtggggagtaagtatttttagaaaatga

SEQ ID NO: 403414 - DNA, 478 bp, Homo sapiens
agcctcttgatggagttccattgtttaccctcttactttcatcccgttgcctttgttgcatgcctctgaagaacatttgaccagtcaccaaaaacagtgcccgaggccaattacctttctccctgggaatcatctggccagtgggatgcaaaaagtccacctagtcagacagattttgtgctttgtgaattttgtgaagggaacttttgatttttaaaaacagtgctgagttctttgttgacttgttcccttttatgtctttttcaagaatttatagacctaacacaaaggaatgttttagaacagtattttttctattgtaaaatagaaggattcatgccttctcttgcctcatcagatacttgaagccttttgattatgaagcagtagtaaaccatatgcttgcacatttctagtgatggggaactcactacctcccaagcccacgtagtctatcatctttggacagctctggctc

SEQ ID NO: 403415 - DNA, 396 bp, Homo sapiens
tttttcaattattaatatagttttgtgctcttaaatttttaatgcaatttatattttggtagtatctaaagtatcaatcattttattattcattcaccttaaaatgtggctatggtttggacatttggattaagtgatgacattgtaattcagccagaactggcagtaatcatcagtgtttggcatgttttgagaacaaaagtcccagttcctggaagggtggccctttatgtgaacacagagtgcacactctgtatggtgtaatccaagacagttgaacggtctgcctgccaaaaatatgccttccaccaggtttttataaagactagtattaccagcttgaaggccattttctgatttagggcattaaaacctaaggaccatgttaaaagactg

SEQ ID NO: 403416 - DNA, 422 bp, Homo sapiens
tgctgcaagagtatgatttgctgcattcaaacattccaagacagcttaacatctacatacagtagtatgttcctggtcttcccagtgcaggttagaagacagacagaagaatgggtggggtttgcacattggtctcaaagtcaggacagacctgggaactacgttccaaatcagttatgaccacatttcctgggttagaaaacaccttctcctatctcgttcctcaaagtgcccaatcccaatcccaaaattattattttgggtcccaggaacttcctcaaacaatactgataaaaaggtcactttacctctaacagtcattaacctaaaataagccatctaccaagatcttgttcctccagaccacttggcgtggttagctgttttttctaaaataaacatttcaagaacaagatgtcaaa

SEQ ID NO: 403417 - DNA, 408 bp, Homo sapiens
gtgctgggattacaggcgtgagcccggctagttaaatgacttaaaattccagatagaataagttcagtgagacttcaaactaaacttgtagacaccattaccatgacccctctccatactcccaaatttgtggagctgatcttttaagcaaggtcagtgatttcccacacatctaggtctggattaggtaccccaagtatttcaaggctcaagatattgtaagtaccatgttatctataacataggtttgatcatcataactttttgtctccttaaaagtaggattggaaacacgatggtggccacagaagttggaatccactgagtgtgtaacaactcacctgccaaaataagaaaaaaaagaaaagtagggtggctccaagatttttgataaaacaaaaaaactgt

SEQ ID NO: 403418 - DNA, 444 bp, Homo sapiens
tggcctcccaaagtgctgggattacaggcgtgagccaccgcaccttgccttgagtaaatatcttaatgtatgtatgcaagtatttcaatagaatagttacctaataatggaattacatattttaagtttgacagattctaccaaattaccctccaaaagagtctaccaatttatccattctcttacagtatataaagtggcccatttccctatccagcagcatttaaacaagctcaagtctccctttaaaagaaaaaaaaaaatccggagccacgcacagtggctcatgcctgtaatcccagcacttttgtaggccaaggcaggaggaccatttgagcccagaagtttgaggttacagtgggctatgagggcactgctgcactccagcctgggcaacagagtgagaccctgtctctgaaaaaaataaaatcctcccttgatccc

SEQ ID NO: 403419 - DNA, 378 bp, Homo sapiens
aaaaaagagtatgacttgctgaaagtctcagatgatcatttgcatttttagcaataaagtatttttcaaattaagatatgaacattatttccacataatgctgttgcacatttaaaaggctacagtataatgtaaatataacttttatatatactgagatacgaaaaagtttgtgtgactcattttgttgcaatatttgctttatggaggtagtctgtaaccaggcccataatatctctgagatatgcctgtttttaaagaagtaatgtctagaaatttttcagatttgttaaacagctgtaaattcacagattccaacatttgatggaacccagcaggataaatataaagaaacatgacgtctgaaaatctgtgact

SEQ ID NO: 403420 - DNA, 752 bp, Homo sapiens
gcttaaagatgatctttccaataagagattatagtctttctcacttggaaaattggtttgttgatctggaggggaatggggggctatttcatggtttctgaaggccaagattccctctgagtggatttatcgtttgagccacctgtgtacttagactcccactcactttcttcaaggagaatcctgctgtctatggatttagccaggtttaaaatatatttatagtaggaactaccaaacattatctcaagctgagctataagaaagcccatcaaagttaacttccaaggcattctgatagttatgccttgattctggatcttgattttcccacacttctgttttcctttttatgtggaaaaaaaaatcagaggaaaactcagtattcagaaagaaaaaatgtacaggaaaataccagcctggacaatgataggtaaaggaatgccaggaactctgccgactgctaccaggatgacagaatctagcttcagaatccagttgctggaggctttctcttaaaagagcttaatagaaccttcatgcattatcaacgctcatttcccaatgtctcctcaaatgaggaattaatgttaacagatcagagggacacccaaaactgactagatgagcttactgtgactgtcctccctttgtagctcatttataaactgtaaaactcgcagtaatatagctcctgaggttatatgcagcaatttacctcattttcttttctcactcataatatagtatta

SEQ ID NO: 403421 - DNA, 544 bp, Homo sapiens
aggtgtacatcctgataggacttatagaggcaagtctaggggcagtacagaggcaagacagatgatgcagtgaagagagaaagggatttcagaagttcttgaacaaccaaagggactacgatctagtacagaagtgaatatgggtaagctttaggcacacagttcatttattttagcaggctggaacacaaagcaagattatttatttgagaataagaccaggaatcaggtattggaagtttaacgtgcagtctgcgagttggtatagagaaggcagagctgcaatccggatggtctggactttctgtggtgacaggctaaaagggatttaggatctaaaaatagtcctcatgatatgtttgggggatgcttaggggagcttggtaccaagtggataatcacttaaatttagtcatctacacgtgactggttttcaccaatttgtagaagggagtgctaggaggggaggaaaggtcaaaaaactggtagtctcatcaagaatttcaaaggctctttggggcacctcccttaaatcctgtaatta

SEQ ID NO: 403422 - DNA, 512 bp, Homo sapiens
agctgggcggggaggagggggcctcagggggctgttatgataagcaagagctcagtctaaagacatgttcccaagctgaaggtttcatttcctgccaggcaactcacccgtttgaatcaaacacagaatttagtattcaccatagaacaatcatatgacaaaaactttgcagagtttacccagatgtaggttttccttaaggtaaaagaggagtcatattaccgaagcctcatcttctcacgagttcaaaacctctccaacctctcaggagaaaccaagggccggaaaggttaaaggcctcaccctcaaggtcccaccaaagaatcgaagctggtgccagctctccgactcctacccagcaacccgccccaggtggccagcagctgcctctgagaatgcagaaggccgaggggggctgagagtgtttctaaatcacagcacacttgctccatcccgatggccttgtgatgcctgaggcatgagggcaggccaggacaggagccaaaaagcgg

SEQ ID NO: 403423 - DNA, 472 bp, Homo sapiens
aaaggctgaagaaccctaagcccaccagccctcagtgtgcaggatttagacacacaatcaacagaaatacagaaatgcccgttttagcacctcatgtaaaccctacacttttacatttcatgtcaatcctctagataatctttttgttgttattgaggcggagtcttgctctgttgcccaggctggcatggagtggtgtgatcttggctcactgcaccctctgcctcctgggttctggtgattctcctgactcagcctgggattacaggtgcatgccactacacctggctaatttttgtatttttagtagagacagggtttcaacatattggccaggctggtctcgaactcctgacctcaagagatccatctgccttggcctcttaaagtgctgggattataggtgtgagccaccatgcctggcctctaggtaaccttttatttgaagttgagatttgccttgattagtaca

SEQ ID NO: 403424 - DNA, 906 bp, Homo sapiens
cgggcccggccggggcccgggcgcgaggagcggggcgggggcgtggggaccaggagtcggcggaccgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaaggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatgagtgttaaaggcatcgggagtaaaaccacagccagcactgttaagagaaccagataccttaccttcctaattgagtcagcagacaatggatatttttatatccaaaggggaaagacttgatggtacgtggagcagtctgaccagtggcatctgtagccttcgggattatagcatgttaatgaaatttttttaaagcagtagttcatatttttaagtatattgacctatttgctgactttctgattgaaatacattctactttgtgaagctgatttgattatgtatgtatatatttattcatattattagtttttattgaatgataccttaatttgtattcatattaatgtaggtctaaagggtttaatgtggttatttatataattaaagttccatggttcttaaaattacc

SEQ ID NO: 403425 - DNA, 609 bp, Homo sapiens
agaagcctaggattcagtgtgatttgtccccttcatgtcccccagactccagaaaggtgctcaggttaaatggtgtctcatctgtgtatgccgcacttgcactacacctgagggtccctggaagacatctctctctgggttttatattccatggtgatatgacttgctggctaaagcattacagtgtactgtttctggtcgggactggaacagaacttgagctgttttggtcagtcccttcctatcttaagatgttgtgttgtacaattattcttaagaactacaagtgaaaaaaggaggagaactgggtggtccaaggccaccagagcactgtcctgcagatcccaaggagccaatttaaactaagaaaggtattggctgagatagtgaaagaagtctttcctccttctgatcagaggagtaaaaagaaaaaaaaaaatcaatagcatcttcaaatctgctggcttaggcagataatcagtgggataatgaccagtgaatatactaatagaaggactgagagtcaggtgagctaggaaggcaatgaagttgaacagctcttgaagaagtaagcctgagaaaggagggaaataagtctcatgatatgct

SEQ ID NO: 403426 - DNA, 741 bp, Homo sapiens
gtaggattgtattagttcttcagatgtttggtagacttcagcaatgaagccattgggtccaaggcttttctttactgggagactttctgttacggctttggtctcattacttactattggtctgttcaggttttggatttcttcctggttcagtcttggtaagttatatgtgtctaggaatttgtcccttcttctagattttccaatttattggcatacagttgctcatagtagccactaatgatcctttggatttctgcagtatcagtagtaatttagtctcctttttaatttctgattttatttttaaatgtgcatactttttaagaaagaatttctaaagaaaagatacatatgccaaaatagaagtataatattattcatcactttatgtataacaacaaaaaaattaggaagtaacttaaaagactaaatagtagcctgttgactaaatacctttgatttgcagtgtggcagttcatcagatgtttattgtgttttgtgtttacgtctgtgtatgatagccctaaatagaaatataagatacagttagtttgaggagcattgtattatggagagttgggtacacatgtgaaaagtggaatagtataaaacagtagatgagagaaagagccttgcctcttctttaatatcttttcttagaattgaaggtaatgccttatgggaatagggccttattaaatgttaatgattaacattttgaagattattaaggttttt

SEQ ID NO: 403427 - DNA, 713 bp, Homo sapiens
gtaggattgtattagttcttcagatgtttggtagacttcagcaatgaagccattgggtccaaggcttttctttactgggagactttctgttacggctttggtctcattacttactattggtctgttcaggttttggatttcttcctggttcagtcttggtaagttatatgtgtctaggaatttgtcccttcttctagattttccaatttattggcatacagttgctcatagtagccactaatgatcctttggatttctgcagtatcagtagtaatttagtctcctttttaatttctgattttatttttaaatgtgcatactttttaagaaagaatttctaaagaaaagatacatatgccaaaatagaagtataatattattcatcactttatgtataacaacaaaaaaattaggaagtaacttaaaagactaaatagtagcctgttgactaaatacctttgatttgcagtgtggcagttcatcagatgtttattgtgttttgtgtttacgtctgtgtatgatagccctaaatagaaatataagatacagttagtttgaggagcattgtattatggagagttgggtacacatgtgtctttctagaattgaggtatgcctatgggaataggcctattaatgttatgataacatttgagatattaaggttttgcgatccctgtttatagcattcttccttacacgggccattttgc

SEQ ID NO: 403428 - DNA, 563 bp, Homo sapiens
tactaatttgttttcatggtattctgttttttaccttttctttattgtattgattcatttaggagactgagtctcactctgtcacccagcctggagtgcagtggcatgatctcagctcactgcaacctccacctcccaggttcaagctattcttctgccccagcctcctgagtagctggaactacagacgcatgctgccacacctggctaattttttgtattttggtaaagacagggtttcactgtgttgcccaggctggtcttgtactcctgagctcaagtgatccaccagcctcagccttccaaagtgctaggattacaagcgtgagccactgtgagccaccatgcctggcctattgtatttatttatatttatctaatatttaaagagctttaaactctccatagcaggtacttttattttatttacttatttttatttagttagttatttattaggtaatacttaagaaatatacaaatgtaaaagcatagttcagtaaatattcatgcttgaataaaacatgctctccccctcctcgttacaggcagcctccatgctg

SEQ ID NO: 403429 - DNA, 789 bp, Homo sapiens
tgtacctcattttgggcttttctgatttctttcctcatgattaaactcaagttatacacttttggcaggaacaccacagaagtgttctcagtgcatcatatcagcaggtttgtgataattggatgtcctattaattactagtgatgttaactttgaccacttggttaaggtgatgtctgctaggtttctccatgtaattaatatgtccaggatatctttttagcatgaacactaaattcttttttttttcccctgagtcttgttctgccaggcaagactctgcctcctaggttcaagcaattctcgtgtctcagcctcccgggtagctgggatcataggcctgagccaccatgctctctaattttgtattttaagtagagaccggttttaccatgttggccaggctggtctctaactcctggcctcacgtgattcgcctggcctcctaaagtgctgagattacaggtgtgagccaccgcccctggccttattctgcttttggtatgtcagaaaatttccataaaaaaaaagttagagatgtattaactgaattactacattttccaaaattaagaactaatttctcagaagttgaaaaacagtaagctgtagtcaactgaatatgtaaactaacaaaaacagacagcaagtgtatcttttcttagattcttttgtgggggaaggggagtggctaaaatttatgtctgagaaggttgacagtggttcaaatgtgaagaggcattaaggaaagacaactaggattcaataaagacaggctactaaaattaa

SEQ ID NO: 403430 - DNA, 377 bp, Homo sapiens
tggtggtgcatgcctgtagtcccagctactcaaacacctgtagtctcagccaccctgaggcaggaggatcgcttgggccagggaggtcaaggcagcagtgagccagaattgcaccactccagcccaggcaacagagtgggaccctgtctcaaaaaaacccaaataaacaacaacaacaaaaaaaactataatattttcctatttgttcatcaatagttcaagaggatataaaaaatttttcactaagcgtggtggctggatccttcctcacttgagcccaggaagtcgaggctgcattgagctatgatcacaccattgcactttagcctgggtgacagagtgagataccatctctaaaaaaaagaatttttcagtaa

SEQ ID NO: 403431 - DNA, 585 bp, Homo sapiens
ttttgcagtgtgtatgtgtgtgtacggaactatatagatgttgattgtccctaaatgatcttcttccaaactcatccaaaccatttaatttgtagcaggaatcccaaattgggaagtgagtgtttgcctgttcctttttccactctgtttcctcattggctttgccatttacccaactgcccccattctaagattggtgtttactgatcaagagcaaagctctactgccttaggagtagttcataaaatgattcctagatgtaatattcactctcttccctgcctagtccccttagcaaggacctctctaacattttatgtttgaattgttttcttccagagacaaaggtaagttagatcaagagtaaacagatggagatgttcattcttggaagcagcaagcattttgttatcattgttattgtctgagcaagtgaaaaccagatgagaagagccttgacctgcctccttcactagcagaagtgaagtaggtcgtatctttcttgcagcattcctgtgagcgttagaacaactccggagcccatgagtaaggctactgtgtgttagaattgtgattctgcctgt

SEQ ID NO: 403432 - DNA, 861 bp, Homo sapiens
  misc_feature (800)..(800): n is a, c, g, or t
agctttggacgtgacaccaggaatggctgggcctggacaatggccttcctggcactgcccagccagtcctctgtgcttgttgccagatgcacctgatccctgagtccccagcatgggtctctttctcccaggcagatggggaactcaccttcttctcagatgccccttcccaacataagctgcttctgccctctggccccgagatggccaaggtgagctgtgtagacatagagtctggaggcatggggctggctaacgtggaggcaattctatgaacagacatggccaggccaggaatgcggcatggcctcaggtctcatccttgaaggcctgggctcctggtctgcctgcagacttcctgagaccacgtcttgttctcatctgccagcagatgcctggctcatgggtgagccgggcttaggtggaaacacaggagcccagaggggaaaggatcctcccccagcttgggctggagtcccaacttccaatcatcaatctttgcaaccctggggctggacctggctagttccatggtaaggatccttctccgtcacccagtcagtcccaggctgtgtgggaaactggctgtggtgggcaggtctgaggtctcaagtctgacaggggccactggagcctccaactcaccaatcaaccaagtgtgagaggttgctttggttgaatggccatgtgctggggtctgactggcccagccacagggaggctggcatcccctagctgagtcctggacccagaccctccagggcatggagcccattgtgaggtgtctggtgctgaagtgngtggggaggcccgtgcaggcctacagctttgtcatctgcaacattcctctccccactttct

SEQ ID NO: 403433 - DNA, 448 bp, Homo sapiens
cagacaccaaacggcacatactgattgtatgagtacatttagatatgaaatatctaaaataggtaaatccattgccagtggctgaaatggggagtgattgcttaatgggtatagggttttcctttgggggtgatgaaatgttctggaatcagacagtggtggggttgcacaaccttgaaaactactgaaaaccctgtgaaatgtacagtttaaaatggttaaaatgatacattttatgttgcataaaagaacatttaaaaaaattaatccagtggggtctgatggcaaattgacatgagggaacttttttgagggtgatggaagtgttatcaatctagattagagtgatggttgcacaactgtataaatttataaaaactcatcaaactgtactcttaaaatgtgggtgtattttatggtatgcaattatacctcaataaagctgttt

SEQ ID NO: 403434 - DNA, 430 bp, Homo sapiens
ctgtgatttttctaagcatttatatacatatatatataattcatcataacttcatgaggtgttaagatttccacattaaagataaagaatttggagcactgagaagtaatattactcaaatttattcatggtcacacaggtaggaattgggagtcaggttcaaatccaagcctggtttgcttcataagcttgcctcttaatcacctcatgtgtacttcattaaagagataatgtatatataatatttattattgtgcctatcacttggtgctctctcaataaattttagtattgttttgcttctttctcttcccctattctatataaaaatatgcagttggatgtgtttgcatttactgatgtctaatgtataatttgcactgagttcaaaaaaatattttttatataattattgaaaagacaattggtg

SEQ ID NO: 403435 - DNA, 506 bp, Homo sapiens
gcacgagatgcaaccagttttataatgtaaagcaggcttttatttttatactttcaaaaatgtatgagggttaataaaaatgtttgaagaaaagacaaaattaaaagaaaaaaagtggatataaatccctctgtcacgaatgataaaattgaagtagttggtaacatttggccccgtttcctaagctccccagccttgtagaaagctttgcattttggccgggtgcggtggctcacgcctgtaatcccagcactttgggaggctgaggcgggtggatcacctgaggtcaggagttcgagaccagcctggtcaacatggcaaaaccctgcctttactaaaaatacaaaaattagctgggtctggtggtgcatgcctgtagtgccagctacttgggaggctgagacaggcaaagcacttgaatccagaaggcagaggttgcagtgaaccgagatccggccattacactccagcctgggcaacagagcaagagtccgtctcacaaaaaa

SEQ ID NO: 403436 - DNA, 445 bp, Homo sapiens
gtgggggaaaatttattgtttcctcattttcccccagcattatttgagtgtctgcaaatgcatattggtagtttttctagtaggacctggtttgtggttgttaatggtaaatgtgaaaattagatgtagtccaggctcaaaaggagtttaaaatctgatagaaataagactttccacaaccactagtgtggcaaaatctctgtgggtaaatgtaacttcaagcataatgtacccatctctcacattttgctcaagttgaatttcttccgttctgaggcagccactccctctgtaccatatgattacatggcttgcttacttgctgtactgcctttagcattgtcggttgggtgttttaaacctgcacgttttatttctcaagtagaccggaggatccttaaaaggtagccaaagaatagaattatataatattttaaaaagtaaa

SEQ ID NO: 403437 - DNA, 457 bp, Homo sapiens
taagagttgtctctaaatcctgggaaaggaaaggggactggggaggtataaacatgaataagtgacccatctataaatgtattttgctaagcatgaatttgattctttcttagaaattgaagagatttagagattggttttctctgaactttgggaaacccatggttagcagagcccgtgataaagttagaagaatgacaaaatgataaaattggatagagtctgctgcatttgaatatgtaatgtgcatttgaatatgtataaagatatagctctgtactgagtatgtatgaaaacattaacctaatatttttacatcctactaatttacagtagacgatgaagtattttgtagaatcttgtggtttttttggttgttttttttgtttgtttgtttttttgagacagggtctcactgtgtcccccaggctagagtgcagtggtatgatcatggctc

SEQ ID NO: 403438 - DNA, 590 bp, Homo sapiens
cattcatttcaaaaggtcatatggtttcgggagacagggcacaggagagggcttggataatatgaggtcactacctagaccacagttcattggcagtgagctcgtggccaatccgtgaatgcatagtctctgagcccacctttcttcatgcattaattttggaaataacttttgtactgcaaattactccgggttcttcaaagaatgagatgagttaatggatgcagctccactgtgcaaaataaaaagattatgcaaatttgaggagtcattatgagaggaaaattggagtaaggtcaagggaatttttccttcactgtttgtggtcgaaaaagtatgtgtcagggtttttaaatgatgcagaagtgatccgtggacatgagaactttccccatttctgacattttctattttcgtttctgctttttctgaacttaaataagacactgtgttctgctgacaagaaaaaaaaatactaaaccccttcatttctctgaatacacagatagatggttagaacctgagaatgacccagcccctggcaagatcatttcatactgttcagaatccactctgccccctgcagggca

SEQ ID NO: 403439 - DNA, 895 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacggtaggcggcggggggggcgcgacagggcttggggtgtcgaccggcacaggcccctccgtttggccccatggaccgggtctctggcgggtagtgggaaccgcgcgtggcgcctccctgcaggttgctctttgccggggctccggagctgccagagcagcaccccctggcccgcgtcggatggggacctgggctgatccttgggacgcctggatcttgggccaacttttttttgcggggaacgggtgtaggggagtcattcctggagcgatgtagggagaggcacttcggagcagcctgttgggggtcgtaggctctgcaggctcagaagcgcctaggaaggac

SEQ ID NO: 403440 - DNA, 853 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcttcaggcgtcactcctgtgtaatgaagagaccagaatgtcagcctgtgaagatcatcatgtgttgggacaaagccctcctccatttcgaacaggaagtcacgttctcctggagtgggaaacataactgagaatcgtttctgccttg

SEQ ID NO: 403441 - DNA, 340 bp, Homo sapiens
cagatattttctatgttaatgaagtagtaacactgttttgggcttggtgtagtggaaaagcccagctgggctttggaatcagacagagctggtgaggatgctaactagacccagtctacatgtgtaacctcctcagtttcttcacagctctgagcatcaatcgcctcaagtgtgaaatggggtgaaatggcacccacctctttggatttttgtgaggattaataagatgtgaataaagtgcttggtccatggtaagtactctgtgggtagcagttaatcacatgctgataggtaatcaatgtggcagatactgttagtgcccacccaatatccatggaag

SEQ ID NO: 403442 - DNA, 486 bp, Homo sapiens
taagtatgtgaggtgatggatttgttaagtagcctgatttaatcagtccacattgtaaacatatatcaaaacatcacactctaccccataaatatacaattattatttgtaaattaaaaataaaatacaaaatcatcagaagggtggaagcaggggaaaaaaaaaacagtgatcttctttacaatacttctatcatctttagaggcagctccaggtcctgccttcctgggaagagagaattcactgtattgtaagatacgagtcgcccctccctcgcatgtgagccagagctggttaacaggcactgccttgcagggcccgcctggtgctgtgcagtctttggtgtgcctgcaggagccatgcatggctgagaccctggatgcagccatgacctctgtccactgtcctgtagcagctggagggctgagctcatcacccaggtccttatctacctgcccatcattaccagagacagatttggaaaag

SEQ ID NO: 403443 - DNA, 447 bp, Homo sapiens
  misc_feature (16)..(16): n is a, c, g, or t
  misc_feature (260)..(260): n is a, c, g, or t
ctttcaccacaggggntgagcaagacactggatggaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcntgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagacca

SEQ ID NO: 403444 - DNA, 2784 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403445 - DNA, 3808 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagtgcaccgtgaaaaaaaacgtcgtttatcgtgtcactaggaacagtcctggcctcatgtccaaaggattccagcccacaccccccattcactataagtttctaactcctggcagcatgatgacgtggtggaggaagacaaagttcccatggaaagctgcagagccagctaggcttgctgtgctttctcgtcatttgtagaaagagatggcaagtggaactcagatgccaccaggtaagtaaggggtacagccacctcccatttctgggatggtggagacaaatacctttttaaaataagcaaaaaaccttacatcagtgtctaacaaacattgtttccaagcttttaagtaaattagtgaggcaagttatttctgaataactttttaaattagtgaggcaagtcttttccctttgcaagtttattaaaataaaacatttgtaggccaggcatggtggctcatgcctgtaatcccagcactttgggaggctgaggcaggctgatcacctgaggtcaggagttcgagaccagcctggcc

SEQ ID NO: 403446 - DNA, 3307 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttagaaaaaaaaaaaccggggatttttcggggcgaaaac

SEQ ID NO: 403447 - DNA, 2712 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403448 - DNA, 857 bp, Homo sapiens
tgcagggcccgcctggtgctgtgcagtctttggtgtgcctgcaggagccatgcatggctgagaccctggatgcagccatgacctctgtccactgtcctgtagcagctggagggctgagctcatcacccaggtccttatctacctgcccatcattaccagagacagatttggaaaaggcccctgcccctttgagatccactgaagcagccagtgtgtccacatttggccaagatgctgttacttcccattaagggaatgggcgtgtccagctaggaagctgactttgtagggatacccaaaaagcttttgttgggcatctgagatagcccctcggaagcaaggttggatggcctgggagcggaagagtagagcaggcgtctcttctaacctgtcataatcctgtgggtggtctgctttgatgaaattagggatggcaacatctgtgtcaggttttgggttcctctaaggcataaagtggctcattctcagctccgtgtgttacagcgaggggagtgtatccaccaagcagattgtctttcttcagagaccgtgtctacctcagaaaatcaagaagaaggaatcgaaggtaagagactttgatggccttcctaggttttcctcagcagggcttcatcttcagtggattttctgcagcatttgagggggcagcctgctccagcttccaagggctcgcagagcccaaggaacacctgagcccctggcaacccgaatcacatctcaggctgctaaaacgggacagctgaggggactggagggccttgtctgccatcgtcctgctgggccggccagaaggatggaggagagaggctcttctggaggcttcagcctgctagata

SEQ ID NO: 403449 - DNA, 387 bp, Homo sapiens
tttcagcattcatcatatcatttattcaggctcctgagagattccacttaagccgatgaaacagatttttatcatcagttgacctcttctctctccactccctttacaaatcccaacagaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatggtatgtttggaattcacagtccttgggtggccctttgtgaactctgcttctaactcttgaaatc

SEQ ID NO: 403450 - DNA, 435 bp, Homo sapiens
agcattcatcatatcatttattcaggctcctgagagattccacttaagccgatgaaacagatttttatcatcagttgacctcttctctctccactccctttacaaatcccaacagaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatggtatgtttggaattcacagtccttgggtggccctttgtgaactctgcttctaactcttgaaatcttagtccctcttcagagtctgcttcattcagaaagctctgcagccgataacc

SEQ ID NO: 403451 - DNA, 3272 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403452 - DNA, 2666 bp, Homo sapiens
catggcagaaaggctgttctgcccctgcgccctccctggcctctctggggatccctgcagctgatgtattgtgatggagcagtggacttggatgctgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403453 - DNA, 3156 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403454 - DNA, 3218 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcgggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggagggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagttag

SEQ ID NO: 403455 - DNA, 2419 bp, Homo sapiens
cttcctgacagcacacaaccttgattaggaggggctgggagggaggatcgatgagcccctgacccctgggttctgaggctgccagggtcgcttgcagctcggccgcgtggaggtgaccgggcggaactccgagggggcgcggggagagctgggcgggcccaccgctccagcggctgctgtcaggggccgcgaggctttccctgaagatgcagcgtagcatattttgcacatgagttcagaggaagaggaagtgtagccggcggacgcgcggcggcggcggcgggggcgcgtcggggctggagccggagcgcgccgggcgctgggcgcagcgagcgagagcgcggcggccgcgggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccgtgtctacctcagaaaatcaagaagaaggaatcgaagtttcagtggcgattctccagagaagaaatgcacaacaggcagatgaggaaatcaaaagttacttacggcaataaatcatctatgagttagtgcaccgtgaaaaaaaacgtcgtttatcgtgtcactaggaacagtcctggcctcatgtccaaaggattccagcccacaccccccattcactataagtttctaactcctggcagcatgatgacgtggtggaggaagacaaagttcccatggaaagctgcagagccagctaggcttgctgtgctttctcgtcatttgtagaaagagatggcaagtggaactcagatgccaccagtttcttcacagctctgagcatcaatcgcctcaagtgtgaaatggggtgaaatggcacccacctctttggatttttgtgaggattaataagatgtgaataaagtgcttggtccatggtaagtactctgtgggtagcagttaatcacatgctgataggtaatcaatgtggcagatactgttagtgcccacccaatatccatggaag

SEQ ID NO: 403456 - DNA, 399 bp, Homo sapiens
aatgtttagaactcagatttcctctgatcttgtttctctgatctgattccacatgctttctttcctttgagaaatcctcaaaatctgtgatctgcttagcactcttccttgctttcactgaaaatttgaatttattcttttaagtatttcattttactggatttaggatggaaaggggttcagttatgtgcataaagtctatcatctcaacccagtcttagtttttattattttacatatatgtatctgtagtttcatataatatcatccctatgtatgattgactcaaaatgttattaaagatctgaacattatttctagttttctttactgtaaagaaacgcatttccagctgaagtatacttaaaactatagaatatgttaagtttattttgcaag

SEQ ID NO: 403457 - DNA, 324 bp, Homo sapiens
aagggaatttgctgggagtcaggaagaataatttccagttctggagaattcttggtcttcctctctggcttccatatgaagtacctccctcctgtttcctgggtgcatcatcacaacccatcagcttcagggttcatccagagcagcctcagcggattcatgtccccatgttgctgagactgcttaactgtgggtctcactccttacatgctaacttcacctcggaaggcgcagggagcttcgctgtggctctgcacactcagtaggatgtgcttctcgccaacagaatcaaccaaaggacacgttccccttctgtcactagag

SEQ ID NO: 403458 - DNA, 490 bp, Homo sapiens
tagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggcaactcagtgagacgccatctctaca

SEQ ID NO: 403459 - DNA, 447 bp, Homo sapiens
taggatcttgcaggtatgatgaaggtaaggattttaagatgagatcatcataaatttagagtgggtcctacacctgatgactcgtgtgcttctaagggaagcaaaagggagttataacacagggacacctggaaggccatgtgaaggcaaaggctaacattggatttatgttgccacaagccaaggaatgacaggggtgctggcaactgcaagaactgagaagacaggcatggaacgaattcttcctcagaacctccagaaggaactcaccctgctgacactttgatttcagactctggcctccagaactgtgaaagaacaagtgtctcttgttttaagccacccagtttgtggtaatttgtcacaacaatccaaggaaactaatagaaaccccacacattgggtatgagcatagaagtaaattggaaatgacttacattgccttga

SEQ ID NO: 403460 - DNA, 443 bp, Homo sapiens
aggtttggggtcaccagagccattctggcagcatccagagagcagggccttggttgtagggtcagtgcctggcgtctgagatgggacaggtgcacatgtacctaccccaccaccccagagaggcagagtgatgtgaggattaagggctgactctgggaccagctgcctgggccaaatcctgataaccaagtgtatgacgttggccaggatacttattcagaaaccgctgtccacatgtgagatgtgataacgttatcatgcttgtaattccagtgctttgggaggctgaggcgggaggatctcttgaggccaggagttcaagaccagcccatagcaacatagcaagaccccacccctataaaaggggaggcgaaggcaggtagattgtttgagcccaggggttcgagaccagcatgagcaagcgggtgaaaccccatctctac

SEQ ID NO: 403461 - DNA, 132 bp, Homo sapiens
gatgtttttctcaaaaagataccagaagagagggagtggtcttacattaagttcttaaagtgttctgtattagggatcctcttttgattattttgattaacaaagaattctttggagaaaacatatgagctt

SEQ ID NO: 403462 - DNA, 313 bp, Homo sapiens
atgactcatctataaatcctcccaatatttcccccgtgttgcccctaaattcggcagtggctttaggagtgccacagcactggaggtggggttaggggtttgcttcttcacatcatcttgaccacatgtgagtgtgggatattctggtttcctgctgcctcggggtccttgctgttccccactgtgccttctcctgccagccttgcccatatggctctgccatgcggggacagtgctacttctgtgccaatctttattgcctgagtcccccagcacccagactgctgaaattaaaagatgagcaccgacaatt

SEQ ID NO: 403463 - DNA, 422 bp, Homo sapiens
gtgccagactctttaacaaccggatcttgcacaaactaatgaagtgaagacttactcattacttggggaggacactaagtcattcacgagggatccactcccctgacccaaacatctcccaccagatcccacctccaacactggggtcacatttcaacgtgagattcagagggaacaaatattcaaactctatcagctcctgtgtcccaataatttctagttatttacagtagagaatattaactttgctccatgaaatcttggagcactagagggactactgaagggccagccatggtaagagaaggacaacaagaccagggattccagactcccatctgggctgcaactcaaaaatttctacttttatttgttgtatacaatcagattccttataaaactttgtctgaagctgaaatcca

SEQ ID NO: 403464 - DNA, 468 bp, Homo sapiens
ttttttttgagacagcaggctggagttcagtggcacaacctcggctcaccgcagcctctgcctttcaggagaatcacttgagcctgggaggcagatgttacactgaactgagatcacgccactgcactctctagcctgatcaacagagcgagactccatcacacacacacaaaaaaaattaaaaaagagttgggtgcacctggatctaacccctgtctcatccttctgccttgaaggccaaatgcaccctgatacttttcaccaaagagtagaaacaccaccatccacttgaccccaaatgtgactttccacaggatgcaagcacagtgttggaatagccaaagacagtaacaatagaagtgcagggtgagggtgatgaacaggacacactggagagcctgacattggcctagactacgggggtgtcttgatccttcacaaagagcccaaggagcaacccaaagagac

SEQ ID NO: 403465 - DNA, 339 bp, Homo sapiens
agaggtcaaagagacgtatcaaccaaaaaggtgtggtcttcattgaatcctggattcaaaaatgaaagaaaaaaaaaagctcactattttgtaaaaaagcacactttggaaacaagcaaggaaagttcaatatgaattatatcctagataacattacagaatcacagctaactttcggaggtatgataatggtatgagattatgcagaaagtgcagcagatgaatactgaagcatcatgatacttttaacattgaaatgacttatctaaaaaaaagagagctaaagcaaatgtagaaaaatgttaagaacagtggatctaggtgaagggtatatgggtg

SEQ ID NO: 403466 - DNA, 350 bp, Homo sapiens
gagacagagtctcgctctgtcgcccaggctggagtgcagtggtacgatctcagctcaccgcaagctctgtccttcgagttcaagtgattctcctgcctcagcctcctgagtagctgggactacaggcgcatgccaccacgcccagctaatttttgtatttttaatagagacggggtttcaccatgttggccaggatggtctcgaactcctgaccttgtgatccacctgccttggcctcccaaagtgctgggattacaggcgtgagctaccacacctggcctgtagaacattttcatcactccagaaagaaaccctggacctgttagcagtcactcccttctacccttctc

SEQ ID NO: 403467 - DNA, 879 bp, Homo sapiens
ccacgcccaggagcgtgggaaccctgcttaagggctttactagggaaaacggtgctggttcactggggcgcgtttccgggaaggtgaataccggtgaaagttatgctgagggtgaggtaggctctgacgacgcacttgcaggttgaatactggcacatcatttacttgttactcccgtgtgtaaactcaaaaactgacactcgattcagctattggaaagtttttttaatgtggttggaacaactgagccatgtgaaaacacaacaagaaggtaccatcctggaagcagagagcaaacccttatcagataccacacctgctgactcctttatgtgcagcctccaaaaaaaaaaaaaaaaaaaaaaaaaaaaaattttgtggggggccctgggcccctcggaaaggttttttaaacccctcctggggtggggggcggggcccccaggggtaacgggagaccactgggccaaacgggggctcccaagggaaaacggggggccgggaaagggggggggggtcttccccacaaaataaaaaaacgccccgggggggaccccgcgggctttctgaaacaacaaccccaggtggggcgctcggggaggggccccacgggggacctcaatcaacgaggggaggccaggcggagccggaattaaaaattactgggcgcgctggggttgcactgacggagcagcagacgaagtgccagcacgagcaggatctagccgtgctacgacagggactagccgacgagctgatcatagccccacgctgacacctacgccccgacctactcacgcgaccgccatctcccgctatctacgcaggctactacgcactacgcccgcccccgaggacacagcgtgctaacacgccgct

SEQ ID NO: 403468 - DNA, 319 bp, Homo sapiens
cgacactccgtatttttccaaaacgtatttgtaatattctttcaacctgtttgcataatgggacatctcttaaatgcagcaagctttaatgcatttttgccaaataaactcaaaaactgacactcgattcagctattggaaagtttttttaatgtggttggaacaactgagccatgtgaaaacacaacaagaaggtaccatcctggaagcagagagcaaacccttatcagataccacacctgctgactcctttatgtgcagcctccagaactttaagaaataaatttttattatttataaaaataccaagtctgtattt

SEQ ID NO: 403469 - DNA, 335 bp, Homo sapiens
tattttgcatacatattgctgtagtctaaatgtgtaacccaaatttcatatgttgaaacttaattgccggtatgataacattaagaggtggggccatttgggcatgatttagtcatgaggtggaatcctcatgaatgtgattagagaccttataaaagagattgaagggatcatcttagtcccttttctccttcaaccttaagccatgtgaaaacacaacaagaaggtaccatcctggaagcagagagcaaacccttatcagataccacacctgctgactcctttatgtgcagcctccagaactttaagaaataaatttttattatttataaaaa

SEQ ID NO: 403470 - DNA, 532 bp, Homo sapiens
cacgaggacttcccctgggtcaaatctccctccagcagaatcagactttagtgagggctgtgttctcatggcagcacgtggctaaaatgatcatggagacattgctttggaacacatcacactagaaaccgatgtacagtctctcattaacacagtgtaacacagcctagtttacctctgatattagaagttacctctttttccttaactgtagctcagcaagtgaaatagttggcctgtgttacaggatcatgtttgcatgtaaattaagtcccccaggtggctggactctcatggactcaggcaactccgtaagatagtggcatggggaatctgagtgtgattgagagagccccaggtttacacattgtgtgtctcactcactgagggagatggtgggcagaatcccttgcactattttaaggtgttcttcgatttttggttgagtgtgaatagttgtactttgtaccatatacctctcattttgtgaggtacagttgtgacttaaatgcatttttgtgtggatgtcaca

SEQ ID NO: 403471 - DNA, 430 bp, Homo sapiens
agccaaattgtatgtgggtcaggaaactcacaagaagcagggagagcagatacagagcccacttttgtccattgaggagagaagccttactttgggatatcacaggtttagctcatatacatctcttcctccatcgctgagaagccacactgggccaagctatgttctcactcagctaccttggcactaaggaagtggtctttactgggcttcaattcctcctcaatctcaggtttagttgtattcctgtctctctgaaaaaggaaagaaagaaagaaagaaagaaagaaggaaagaaagaaagaaagaaagaaagaaagaaagaaagaaagaaagaaagagagagagaaagaaagagagaaggaaggaaggaaaggaggaaagagaaagaaagaaagagggaaaggaaggaaaggaaggaaagaaagga

SEQ ID NO: 403472 - DNA, 384 bp, Homo sapiens
aagaattagtaaaaataatatcagattttcagttatttcacaagtataaaaattgttagagttctagtcaggatctaaataaggatcacatattacaatttattgacaagtcttttgtcttgttattattttattttctttttttttttttagatggagtctcactctgtcgcccaggcatggtggtatgcacctgtaattccagcttctcaggagtctgaggcaggagaatcgctttatacccaggaggcgcaggttgcagtgagcagagaccatgtcactgcactccagcttgggaaacagagacagagcaagactctatctcaaaacaaacagcaaacaaacaaacaaaaaagggccccatctctgctctctgccctcaaa

SEQ ID NO: 403473 - DNA, 581 bp, Homo sapiens
tgtgtagtattgtgtgttagtcaggctcagtcttcctatccatgaatatgggatgcctttctacttatttgtatgttctttactttctagaatctttatgttgacagctgattagttagatttaacaagactgatataaatttgtgatttctatttttttcttttcttttttgttttttgagatggagtctcactctgtcaccatactggggtgcagtgatgtgatctctgctcacttctacctctgcctcctgggtgcaagtgatttttctgccttatcctcctgagtagctgggactacagtcatgtgccaccatgcctagataatttttgtatttttagtagagatgtggttttaccatgttggccgggatggtctcaatcttttgatgtcgtgatctgcccgcctcagcctcccaaaaagtgctgggattataggcatgagccaccatgcccagccaaatttgtgatatcttgtaccaatattttttggtacaataggcatcaaacaaaaaaaatttatgtaagctagttaaccaaaaaatcacgcttttcctcatggacattttttaatgaatttg

SEQ ID NO: 403474 - DNA, 236 bp, Homo sapiens
gccaacaactaagggaacatataactgtgagacatcatttactaaatgtaaccaagggcggaggacaccttcctgaagtgacatttacactaaaacttgaaaggcaagtaggagctacccatgaaaaggtagaaaagaagattctaagaaaagcacatgcaaaggcacaaaatcaagagaaagcacgagtgtaaaaggcatatcaacagagttcagcatgatggagaaggaagcat

SEQ ID NO: 403475 - DNA, 965 bp, Homo sapiens
tacacctttgctctcacaaaaggtctaaatatattagaattcccctctgtggtcatatttaattcaagacacctcacatacaatttgagaatgcttaggccggggcatggtggctcacgccctgtaatcccagcacttcgggaggccaaggcaggagaatcgcttgagttcgagaccagcctggtcaacacggcaagaccccatctctacaaaaaatacaaaaactagctaggtgaggtggtgggcacctgtaatcccagctactcaggaggctgaggcaagaggatcattcgaacccgcaaggcggaggttgcagtgagccgagatcgtaccactgcactccaacttgggcgacagagcgagactccatctcaaaaaaggagagacagtattctgaaggctacagaggaggagattgctggaagtctgctgggctttatagaagcctagtaggcaacagatgattccagccaacggtcagagccacctgggtaatagagaatgcacaccccattcccactcgcttgattgacaggatgaatgacgctgtgggaacccagctttattgacaggatgaatgaggctgtgagaatccagcctcattcactcagcatgtagccattcactcagcatgtagccacacaacagccatgccaacatagccctttgaagttcattcactaatcaataactttattttacttaaaaagagatttaaaaatataacttatgtctgtgagtattgaaaaattttggagaggatgaggcaatatattcttatgaaaaaagatttttttgggttcaaaatatagttattcctttaaaaagatgctttgtgctggaggtggtggctcatgcttgtaatcccagtactttgggatcacccaggctgatcacttgaggttaggagttcgagaccagcctggtcaacatggtgaaaccccatctctactaaaaatacaaaa

SEQ ID NO: 403476 - DNA, 1421 bp, Homo sapiens
gctcagttagggctcttgccactccccatactggcccccatggcttgtctaaataggaccttgtttcaacttttctacttactgtgaccagccaacaggtgacatatttgtacagcacaaacttgccccagatcagcatgtacatgcagcggaaccagaaggggtggttcttgagggaagaaagcacagtgcattagggatatcacatgactaggcagtttctctcagcactcttccttttcacacttgtggctggctacttcatacctgcctgagtcctgctgccagatgccctcaatagtctggcctgattgccttcacaataggcagagaggaataagcagagggcctggagaatattcattcgcctttcccttggagagcctcaagggcagcactgtatttaacttctctactgtttgccttcgttggcaaagtgtttggaatgagcatttggaatgttaagtacagaggggcccatattggattttaatttaaggagagaaacctgcccagaattactgaactgttttcaagcctttcagctgggcaggagcaaaagccagcacttccccccttcccttggtttctgaattccctagaagtgcccaaatgtatcagtcaagagaagaaaataggatggagaatcagaagctgctgtgctctgaggggtcacgtggatgtgataaggcaagctaggagcggctcctagagaaggcaacgggtgctaaatgtgcacctggcacagccctgtgcccgcgaaggttgttcagtgctggctgatgaacatgtcccagcacggctggcattgacaactcacagatctagagcaaaaccaacatgcacttgtagatgatatttcctacttctctgctatctgtagggatccttgcctgtccattttctagctctggtgcagtcatgctgctgctgctttagtagacactcacgtcatagtcttcagtgaggagatagtcttctgtgatgtgggggctgagcagtgtgtagcccactaggtagaaaaggcccagactcaggcgcttgagagcaggaatgatgctggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgc

SEQ ID NO: 403477 - DNA, 503 bp, Homo sapiens
tcagcagcagtgactgaggctgatgctgagatcagtggtgaaccagacactctactcaagctgcccacactctagtggtggggacaaacaagtaaagctgttgataaacagggcagtggaggacataagtccattggcagagtggaaaggaacgagtgaagttcctggtcacagagagcagagactattcccttcaccctctgaccttcagttatggagaggagtgtttaggggtgtggttgtctacctggaatgggatgagaagctctgctgcccaaagtgtttcctgtttcagggaaagatttctatggctggctatgaggaatggggactgcaaacctcttaagagttgtaggaaagtcagggcagcagacagtggaccagtcttgtgtttacccctcagggatgctactgatctcaaggtcttgccaggtctcacaatctccattgggactgaaaacccagtggaggtaagataataaaaataaccactttgaatctgc

SEQ ID NO: 403478 - DNA, 257 bp, Homo sapiens
atgagaggctccttcacagtggatgctgtgggggacatttacatggtataaaaacatcctcacattctgtgcatagtccacacacctctcccccagccctccatgtcaccaaatatgcagtttactctttcccaagttgctgactaatctgatgaatctgtcaatgactaaccatggattagagggtcattgctcagactatcttccctttcatgcaaataaaccagacctaatgcccgaagcccactggaaagatt

SEQ ID NO: 403479 - DNA, 392 bp, Homo sapiens
tggagaaagccatgccagacagtgagaaacatctgaagccacagggccgtgaggcctccgtggggaggtgcctttcttggctcagcggtgaccactggaatgcagcgactgaccctttgcccctgggtgacttctgaagcctcaagaaggtgaatgagggattttgaccccgtttcctcctaactcagtgccatgtgcgctgctttgcttttctctgcctgggaaccttccccactctgtctgtcaggtcacatgctcgtgccgcaaggctcatgtgccatgtcctctgaaggacggcatctctgacccattctgcctgacaggcagctgaccatctgtgcccacactgtacctggtacttagtcctaaaatagaatttatgaagtggaatg

SEQ ID NO: 403480 - DNA, 442 bp, Homo sapiens
aatggtttaatgctatttaaggtgttactactgagtgccaactttgtgccttgcaatgtgctatgagaaatacaaaagaaaagtaagaatgggctgtgacccaaagttccaccttcacagaagatatgggactttgcaagtagaatggacaagagaaaccactatgttggcagacaccacatgggcaaaggctctgagatgagaatgtgggtgacttgcttgtattagtgatgacataaacaagagagggcaaagagtcacactggggaacagtggggctcagactagggacggtctcaaaaagcagaatatggagactgaacccctgtctgcagaaatttgtggcaccaacatccatgtgagaaacaagacaaactgctcattcatgtgtgcaatgttgtgtaaacctttttgattcaagggaggaaaaagtgccctgacc

SEQ ID NO: 403481 - DNA, 293 bp, Homo sapiens
aaatcaaatactatattgtctgtgtagaagcagaggagctataaccataatggtcatagaagactatctccaaagtgggtcttggagccagccttcaagatgaggtgaagacttggatgagcaagtccaacaggaaacaaattccagacaaagaaacggcatgagcaaagcacaagtgtggagccaagaagaaaaactgacagctgcaagggtcaaaaactcaaaacacctacagcagccaggcaggaatacaatggagaaaagagggtcctgaaaaacaacagctacagtct

SEQ ID NO: 403482 - DNA, 606 bp, Homo sapiens
tgtgagattgcttaaggtgatagtataaagtgataaggaaagtgtatcaaagacagaaccctaagaaaccatcattttaaaggtaagatagagtaggagaggcttccactagggaaaggtggccagagaagagaaaatccagcatagtgcaatatcagcagtcaaggaaagagtattttaaggagtttggagcattgaactgtatgaaagcatagataatttagtaagatgagggttttatatttacatgatgtcctttctaaattttttttagatagaacaattgctttattttttagtgtcttaaaatatgcttttctccagcaattttctgtattatatgttggaggagcctgctatgtaatttgaataataaagtggctatgaaagtgctttgaaaagttacagcattagagaaacatactgttattacacctcttctgtgagtatgctccataaagcacacatgttgaacgtttcacaatagaaatgtgaaataaacattgaagaatatagggagttaagtaaggctctggagaccagtgaaaatgagggatttcttttctaacattaaagcaattagtaaagattgtgttagtattgtgg

SEQ ID NO: 403483 - DNA, 400 bp, Homo sapiens
taactacttacacttatataagttataaatatatatctataattccatcactcaaataaagtacattggagtaattacatcacttaaataaaagtaaagattgctaacaccaatagtaagtgtttattgatagcttattatggcccaggctgtgacctagtgtttttaattaattaattaatacttgttaattaagttaattaacctcattcaatcctctgaattgtgttggatactcacagtagtatttactccgcaaatcaggaaactgtcgctgaggccatagtttgaggccgaggacccaagctgggctgatccagagcctcattcttggccacgtgctcttttgttctgcctcaggcaatgaagcagacaatagattcacagagggatcatggac

SEQ ID NO: 403484 - DNA, 475 bp, Homo sapiens
gcagctgactgaatccctggacgtatatccctggtacttagcaggaccagcactcctgtactctgaatttacttctggaagaataattcccacttgtgctgagagaacccactacagttaccactcggatcacacaaagagttctcaatcctggatgcacatcagaatcatctgctgagctttttagaaataccaattgcctgggccccaccgcaatgcaactgaatcagtatttatagagggaagagggatctaggcatttgtatttaaatattctccagataatttaatgtgcccttaagtaataacaaataaaaacagcaaaggaagcagaaaataattgtagtattctctgaaagatctattaagataccatttcaaagatctatggagatactaagggagaggaacaatactaaaaagttattagtggggaataaaaaaacaaagctatgtttttctgtttttttgtttt

SEQ ID NO: 403485 - DNA, 441 bp, Homo sapiens
agccctgagtgcaaggccaaggtgcccccacagcttcctagttgctgctgagttccccaccccccagatgggaggtatgcacctcccattctgggtctcaatagatcacctgggccccggtcctctgaaagcctattgaatacaagtaagtaacacaaggctgttttgttcattacccctataattcaagaaatccaatttgcgagacagaattgacttgaggccaaaaactccagggtcattctgccccaacttgaatcctggcaccacttactgctatgtgatctcagatgccataactaatctctctaattctatttccctgcatttaaaatgcaggcaatgcccatggtttgccctaatgactcaatgactctgtattaaagggcttactattggcctgtcatgtctcaataaatgtgttactgttctttctctgtg

SEQ ID NO: 403486 - DNA, 485 bp, Homo sapiens
tttccagaccccttttataattcttatggataaaatcctatcaaaatgtggttgaaaatctttcatggtttggatgaaggtatctattgaacctattaattatctgcccctaaaaaccagtatttccttgagcatgacacttcacttttccaggtctcagtctcctcactggtcaatggggaggttggatcaagatgacttttcaagtctcctacaagcacattgctgcttaatgtgcccatacttggtttttctaaatgactaatgatgttacaaaaacctccctgtctttttcctaattatcttttctatattttacgctttcgattacagattaagtgagattattcacatatacagggctatttcattctgatatattttctttttcatatttgagtagcttagctggctgtatttgggtaattttgggctgtctataccttgaaacacaagcaagattcttaatacgaaaagttaaatgc

SEQ ID NO: 403487 - DNA, 186 bp, Homo sapiens
acagtatatagcaattgcaaagttaacatttacttcctcagtacactgaagtggcatagtaccactcaattgtgtcactttttaatactcaacacgttgatactatttcagtatcttaagagcctggtttcatgaagacactacttgcctccacgtattctgcagaaaaaagtctaaatttacaag

SEQ ID NO: 403488 - DNA, 460 bp, Homo sapiens
cctcacccatgtgtattaacaaatatccatggaacacacaactcatttattttggggcagagacttaacttttcaatatattataattatgccctatatttcaaaagttcttctgaggacaaaggcatacaagtgtgcatttactgtaaaccggccaaaactagtttatggtgagtgatcttttatcaggagaaaattaccgaaattggtcccttgtctacttcaatctgtagttatggctggtggaacagtgtctgaggtcagtcagtcagcttatcttgaggctagtgcttgcttggctgctagagaaacacagaaaccttgtggcagttgtaaacatagtctgcttttttaaagtgtaggaatgtgagacttaacgcttgcctggcatgtttttaagtcctgttcataatttggtattttattgttataaagagtctgttttacagtttttattgta

SEQ ID NO: 403489 - DNA, 424 bp, Homo sapiens
gtgagccaccgcacccagccccaaaggcctatctcttaatactactgcattggcaattaagtttcaacatatgtccaggaagaataaggcaggggaaaaaaaaagtttcaacatatgaactttgggggacacatttggaccacagcaatagggggaaaatggagaaatatgtttttaagttatagcttaagataatctaatgggccatgatgtagtaaccaggaccagaattgccctccataaaaacaaacagaaacctagacaaaatatgtgaaacaactttttcagaccttggacaataggcagcacaggcctgttgtccctaagagaaaaaacaagatgaatattgaccacagtgcagggagaggaacagcaaacaagaaccacaaaaatcttgcttttagatgtagtcttgtggaaaaaa

SEQ ID NO: 403490 - DNA, 707 bp, Homo sapiens
ccgccctaaagcactgaaggacatcctgttctttgaaaggggggcagggggctctggaatggagcccggctgctttggccagtttcttcatatttcagggtgttaccttcagaataacattctgaagttattcttgagaactacaagcaaggaaggggagaaaaataaggttgttcctttaatgtatacatcccacggtaccttacttctacaaaaccaaaagacagctcaggaagccttatcaaatttgctgtctccacatctcctgttggaactttcaagtgccaattaacagtatcaagttaattaagaagagaatggatgggggaaaatagttgagattcaaaggacttctcctcatgaaggtggaaattttaaaatcgtcattaagaaaaaaggtgaataaagcaagcattcacaggctgggtatggtgactcacacctgcaatcccagcactttgggaggccgaggcgggtggatcccttgaggtcaggaggtcgagaccagcttggcctacacagtgaaaccctgtctctactaaaaatacaaaacaattagctgggtgtggtggcgcacacctgtaatcccagctactctggaggctgaggcaggagaatggcttgaacctggaatggggagcttgcagtgagccaagatcgtgccactgcactcctccagtctgggcgacagagcgagactccgtctc

SEQ ID NO: 403491 - DNA, 410 bp, Homo sapiens
tagatggagtagtgctcagtcacccaggatggagtgcagcagcacgatctcggctctctaagtgtttgctgactcctaccatgatcaggtcccaggtgcctgcaatgcagtgggaaatgacacagacaaggccactgcccacaaggtgttaacattccacctcaggaccgggcagcaaccgggaaaataaaagggcacatttcaggttgttacaaatgatctgaagaaaataaagcagagtgaggggacacagtgggtgtttcgtacccctgtcccattcgaggactcactcctggagcaatgggaactttcccaccatagccacccagccatcttctcctcagcaacctcaccatggccaaattaggagcagcttctgggagagccagggtctgaagccatgctggcct

SEQ ID NO: 403492 - DNA, 459 bp, Homo sapiens
tagatggagtagtgctcagtcacccaggatggagtgcagcagcacgatctcggctctctaagtgtttgctgactcctaccatgatcaggtcccaggtgcctgcaatgcagtgggaaatgacacagacaaggccactgcccacaaggtgttaacattccacctcaggaccgggcagcaaccgggaaaataaaagggcacatttcaggttgttacaaatgatctgaagaaaataaagcagagtgaggggacacagtggtggggctggcctgggggctgttttaggtggggtggtgttatgagttgcaatgtgtgcccccaaaagatgttgaagtccctaggccgggcgtggtggctcaaacctgtgaggccaaacactctgggaggccaaggcgggcagatcacttgaggtcagtagttcgagaccagcctggccaacatggtgcactctcgtctctacta

SEQ ID NO: 403493 - DNA, 337 bp, Homo sapiens
tatcttttcttattttaaaataaggaggttgaactatatcatttctatgctttctttcattgttagcaatccacgaataatggaacactgcacagaatagtaaacactgggttaagatccagtattggctcgaatccttataactgtgtgatctgaatacagtaatttcttctccctgggccttactttcttcatctgaaaaattacaggattggcctctatcttccttattgtctcttcagactctcatgttttgtagttttcctcagttatggtagaaatctcatccttctcttcttaacatttagtcctgtgctccagggaaagaggagggagt

SEQ ID NO: 403494 - DNA, 629 bp, Homo sapiens
agagtgtgatgtcagaaatgcaaatactgttggagaaatgtacccaaagaacttaaaattttatgagagagtgatgcatatgaaactaattatagtataaggtaggatgaactaaatgtgcaacagagacttaaacagttctgtgggactaggggaagaagtaattgactctgaaggataaggaaaatctaaaggagggaaaggcagatgaataggattccaatagacaaaaaaagggggcattttttggagaaggtggagtcttgaggtccttagacactggtttgagaaactgcacagcaaattatcctgggaaagagaaggggcactttgtatgagagggctagaatcttcctttgaatgttattcagttggcattagtgagtttttgaaagttaaaccacacagattcaaacaatttgaaaaagaaatgatcactctagtttttgtagcctcttttagaataaaaaaaatcttgctatttagcatttcatatttaggctttcacattgccagcagattaatttacctaaaatgcacatccaaccatgccagttttctgtttaaaagcattcaatgactttatagcacatgccagatgaagtattagttcctgagttgagaagagg

SEQ ID NO: 403495 - DNA, 509 bp, Homo sapiens
caatatcccttgtggatcaagaatggcctctggagttccggttcccttggcagttacagttttcactataaatcctttaattggatattggacaaaatcccccacatagagatctttattttatgtttgaatctgatatcacattgatgtctcacccatgaattgccaagagaaaaattcgctttcttaatcgcattttctacctcatctattatttgcattttgggttaatgcactttactgacgtcggagtctggttaataattttattgtagtattacttctcttcatgtttgagctcctttgcccgcatcaccccttaacaatttatacttctctcatgccactttttgtatgcatttttgtacttgcactttataataaagtaatttatgtgaagttttcctgtcatatgcctgcactgtaaattgcttgtgtcttctttattcttaaaaatggtgattgaaaaaatagtagacatttaataaatatttgttgggtttaataaa

SEQ ID NO: 403496 - DNA, 383 bp, Homo sapiens
cctaagggtagaaagggactctaaaggccaggccaaatacttctaaaaatgaaagtaaccacttgcaaatcagtaagccttgcttttgaaagaatgatacactgtgtttccttgggggcagataaggaagagtcataacctaagtgttgtcagttcaatattccataaacactaatgagaaccaagttctgtaaagagagaatggattatttgaaatttaatagatgaacaaaggaaggatcattgtctatagaccatgaggtcctggaagacagaaaccacttgtttgatactttgtagctctgtcagcacatggaaagaaactggttttcctgtaaaactaatacatgtgattattaaaggtaaaaacataacaaatcaaa

SEQ ID NO: 403497 - DNA, 430 bp, Homo sapiens
cccccccccccgccggggagtgaaacagctgctggagacttgatcctggcccagatgtagccagggaaggaaaagctaaggccaaaaatggacggggactgactgggctgcccagactcaaaggggccctgggagctgaaagcaggcaaggacagacctgtcacacaccagagcacaaatgcggctgggaacacacatctgtgtctgtcatcaaccgactttatcgaacgccttaaacaatctgcctgcctctgtcgcacgctccccagactcagatttttatgcggattgtaacccggctgcctgaggtgtgatcagccctctttcctggtagctctgcaaagggtcctgcacttacccctagggagcccctctgtgaagccccagaggcttcctcccagaatctcaagacaatgagaaacgcgaaaca

SEQ ID NO: 403498 - DNA, 450 bp, Homo sapiens
acagaaaggcccgggaggggctgcagctcccaagtgacagctctggatccgggcaaggataaagacacccccgggtggcatggaggagcagactaaaggtcaggcgtctgcccatgtccaaagccaaagtcgtggtacataaggcactgcccacccctcgcaccttatgtcctaggggcacggcacagtcacgcagatgactcagctgcgccttaggaaatccaagcatgactatgagaccacatcacagaggaaaggggtgccagggccgccagctgccagggcagaggtaaggacggggcagccctgcacctaaatctgccatctatgctcccacagccccactgtgcgcccaccctacgcagggcagcagggagaaggggacttccaggcccactaactggaaagacagtccgtggaacacagcacagtgggcactatgggtcagac

SEQ ID NO: 403499 - DNA, 338 bp, Homo sapiens
tggtcattatgaaaaatgaacttgaaaaaaatcttggcttttctccctttccattatgtatttctctctctctcttggtttttttaaattagcaatcccatgaactttttggtattttggcatatttttataaaattctttgaactaaaactaatctctgagggatgtttagaaaggcaagtgttactaaaagttgtgcatacattgaaatggttatagtcatagcaaataaaattgttatttctcaagtgagaaaagaaaaagattttcttgggttttaattaaagtacattttcgcagctcaccattatctgatttgaaggtttctttctctacag

SEQ ID NO: 403500 - DNA, 454 bp, Homo sapiens
tttcactatttcttctactgctatctactaagaacttcaaagaggaaccaggactacgggaggagcatgaatgtggacaaggagtgtgaccactgaagcacagcaccacagggaggggttcaagcctctggatgactactggcaagcctggacaatatccaatctcccacaagaaggtggtggagcagagtgttccctgactcctccaagtaaaggagactccctttcacggtctactaagtaacaggtgccttcccaggcactggcgttaccacttgaccaaggagccctcaagcggcccttatgcgggcgtgacagagggctggctcacctcttgccttctaggtcacttctcacaatgtcccttcagcacctgaccctgtatctgccggttattccttggttatattagtagtacaacaaagagtaatattaaaagctaatgactagtaat

SEQ ID NO: 403501 - DNA, 364 bp, Homo sapiens
gatatgatcatatggtttttcttcctagcctgttgatgtgttgaattgtattaattgagttttcaaatggttgaatcagccttgcatatccataataaattccaattggttatggtgtatagttttgtttacatattgtaaatttgatttagcaatactttgttgaggatttttgcatctatgttcataaaatatgttggcctgtatttttcctttcttgtaatgtcttcatctgattttgatagtaaagtaatactcaccttatagaataaggtaagaagtgcttcctttgctactattctttgggatgagactgtagagaattgatattacatcttcttcaaatgtttggaggaactcaaca

SEQ ID NO: 403502 - DNA, 160 bp, Homo sapiens
tagtgatgtcctaaaacatgcccagagaacaatgccagaagtgacagacagcacaaagatgaagaaggcatgagtctagccatcatagagcttatgtaacccaattctaaggatgagcaaatattaaaaggttaaaagggctgagaggcttgagagtaga

SEQ ID NO: 403503 - DNA, 336 bp, Homo sapiens
cagcccacacttctccagacaatttatattcttggatgggatctccagaaggacattgccacctcttctatattttgcaaacaattctagaatcttaatcaaagaaccactggctacacataggccacattgctgaggtgaggtttgttaaccccattttaccagaggaaaaagagaaaagtgagaatatgaaagatcaggtgcctggatgataaatcactgagcttgcattcaaaatcaagtgactttcacttcctgattcctcctcctatttttctctatagacaatatgtgaagtctaaaaataaaattttaattcagtagaagtttcagcaa

SEQ ID NO: 403504 - DNA, 409 bp, Homo sapiens
tcttgtattttactcaaacaagctccaaaaaacttcctcattcaggtagtcacaagccaccactttttagagatgaggaaactgttgctcagaaggtttaagtgactcagagatagtaagtggagaattggacacatgcttgcatgcacatacacatgcacacgcacgcgcatgtgcgcacacacacacaaacacacactccacccaatgtgaggatggatacaatcagaccttcaatcccagtcactcacatacctgaagacacctgtctttctgtctctgtatccatctgccctgcaaatctataccctcctgtcagtatttggtggatggaaacctcagtttctctcgtcagctctcttctttgacaagagaatcgagccatcctggctctgtctttctgcagctt

SEQ ID NO: 403505 - DNA, 545 bp, Homo sapiens
accttctctccagtctccttaccattagggcctttcactacctggccttggtgtccctaggctgctcttcagctgtccacaaaccttgtttcataagcagtagcaatgcaagcttccactgccgtctgctaatgttcttccctcctagaatgttcatgatctgcgtttctacctgaaaggtctagttcaaaggtagctgaaaggttatcatccttgtcctttcttctctccctaccagtcatctatcctgaactttttaacagtagggacagtgttgcaattgtgtttgtgtccccagcacgtagcacacagtacctagtatacagtacctgtagcacataggcatttaataagtgtgtattgaattaacttggttatgcttgtatttttatcctagctttctcaaagaaacttaggtgctagctattttgaaacatatatccagaaccaccacctgagtaaaatgtataacaggaccctgctctttctatcccagagagtttgagaaaactacttttaaataaatcattaatcattctaaaatg

SEQ ID NO: 403506 - DNA, 286 bp, Homo sapiens
gttgtgcagtgggaagggtcgttaacctgcatgtgtgagagaggaaaggcattctcacctaacaggtttgtgatgtgttactattttctgtttcttcctctccaaactcagtgggccgagaaagtgtaaaacaactttcctcaatcatggctccacactggaatcactgagcaagctttaaataataccgatgctcaggttccacccctgggatttagatgtaattggtccaggagatggcctgaacatcggtatttttaatagctgcttgcgtgattctaaatag

SEQ ID NO: 403507 - DNA, 730 bp, Homo sapiens
tcagagaggtggagtgaaggaatgtggaagaaccatataggtaaatgtgtgctattgtaagtattatagttgtttttgttgttgagacagcgtctcttgctctgccgcccaggctggatgcagtggtgtgatctcggttcactgtaacctccgcctccagggttcaagcgattctcatgcctcagcctcccaagtagccatgattacaggcctgcactaccaggcttagctaatatttgtatttttagtagagatggggtttctccatgttggccaggccagtctccaactcctggcttcaagtgattcgccccccttggcctcccatgtgagccaccaaacccagctgtacctattatagttcttctgtcgagttttaagttcataagtgttaattagttaaccaaacaataattacagtatgtcatgaaccaagaattgtgaataatccaatgctgtgtatggtaaattaaaacttttttctctctaaaagtgacagtcctttaaatagtaaaatctggctaacatgacttgcttttatttttttagttccaggctaaaaatgctaatttctttatatcattttcatgtatcttggtatgactaaaacttgacttattttcttcccattcttttcttctccatttcatgtttcagctgatgacgctatactcctctgagccactaaggcatgagaatttggaatcatctctgaatccctcctcatttt

SEQ ID NO: 403508 - DNA, 174 bp, Homo sapiens
tgattatgtgcttctgtctggtttcagacagtttcttcagatcggagctgtaattcacccaaagtttgtttttcctttaacattaagttagagattgagagtaattctctggtataactttctaaaggtttttttacattctttgtaacttacctctctgtactgctactattg

SEQ ID NO: 403509 - DNA, 925 bp, Homo sapiens
cagagattctgcagttccctagagacctgctggcccctgtggttgtgaaagtcaaagcgggttgtggggtacgtttgcagggggtctggtgatgtggcaattcaaaggctgaggttccctggggagggcagtgggccacaatcggtgaacaaccaatatggcacctgctgtctcagttcaggcctaaggggtatgcaggcacttctgtgtgagttggtacctggttctctatccctggaagttcccagattgccaccaacagcatttcctggggtcatgagagcacagggactcctcaaaaatttggtggtcagcaaattgttacaggggtaagaggagcagagaagccctaccctttccgtagggctatgggtttctcaggggttgatctctgctgcactcctgctgctttccttttctgcactacagcttcattctctggactctctgacagatcctggttgtcttccttcattttttcattcagattttgaccattcacctataattttgatcttatttctgaggagaactggcatctgacatccctagttagccatcttgaaaaaaaaaaagcaacaaaaaactgatgctccctttgtgagaatccatgcttaaattctccttagaccactaagacaggaaaggcttacttctgagcaggtgggctattttctatcttgtagaatcacagtcatcctgaccacatgtaggtggttgtgcttctgttatttcccctcctgtagctaccaggaagctaagcctttcaatatattatttttccaaaattttattcttaaaaattttaaacatataaaagttgaaagaattttacagttaacatctacctgtcgtctatattccactccttacattttattatacctcctatatcatatatctttccatgtatctatatatctat

SEQ ID NO: 403510 - DNA, 298 bp, Homo sapiens
ggcttcagctcacttctgactcatgtcccttgataactgagttcttcttccccaagaaccttaattattttcatcactggttcttcaattgttccttggcctgatttcttctgttgtcttagacacttgatcacaaaacaggaagcctgagagctgggtgcaagctccacttccattgtcctctaagccagagctgagtgtggcccaaggacattgtgttgtaggaacattttcttggatgttaccttatttgtagcaatttagaatttcagaataaatcatccaaaatgctttcctc

SEQ ID NO: 403511 - DNA, 224 bp, Homo sapiens
ccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctca

SEQ ID NO: 403512 - DNA, 426 bp, Homo sapiens
gtggcaaaactgctggctagtgtacctgttctgccaaaagtaaaatgggcttactgaggaaattaaatttatgttcaagtgctatttctttatgcaccggggaacaagcatttctaacaacctggtcctacgtggctgaaactggatcccagaagccccgtccttcccgaagctcgtagcggaagtgacatcagcccgccgccactatcttttcccgcgctggctgcccacggtcagtgctgtttcacctttatcttggtggagtcgaccccggctgtggacttcaaataaccctgtacaaagaggaatggagattgcctctattcacctagattcataagttgccctgaggcaatcttggcatcaaggaagagagcattgaggcacaactgaccatcagcttcagagaatggcagtcactgattt

SEQ ID NO: 403513 - DNA, 219 bp, Homo sapiens
ataaatacaactataaatatattttcatttagtcagaggttaaatgtgtttccactttaaaaatactttgtttatatttgggaaattactactactgaaaatacagtaaaagagaaaggaaagtctttgagagtggtgaaaaaagcactgactggggctttatgtgacctagggtccaatctttactttgttagctaattagacaggcaggtcttagac

SEQ ID NO: 403514 - DNA, 644 bp, Homo sapiens
tatttgggaaggaaaaaataagtgcataaatgtatgcctttgaacttccaaaatgtcaaggtcatcacctttaacctttctgaataattaggcgccttaagttcttcttgattttcagctgccacccactctcacacatacatgctcacacatatagagagccacacacacatttatgaccacacaaaatcataccaggagctcaccataaatctaagaaaattcctaatttcaggatcaataaccttaatttccctgcaaacgtttgtgtaatgcaatagcagtcaacttctttttaaaaatactgattagattaaaatgccttctagctgctttcactacagctaggaaaggctgagaattctggcggggggtcttaaatagtggtcccctttgctttaatgaagaactacagttttaaaatcaagcctttgaaagaggaagttctgtgcagccttacaccttcattaaatttgaaagcaatttgccaccctgtgaaataaattattgcactttctacaataaggaacaaaaggaaatatagttataatgcttttaaaagcatcctttggtgaaagatgcaatggaaacaaagcctacttaacatccccctcccccccgcaaaaaaaaaaaaaaaaaaaaaa

SEQ ID NO: 403515 - DNA, 1279 bp, Homo sapiens
tatttgggaaggaaaaaataagtgcataaatgtatgcctttgaacttccaaaatgtcaaggtcatcacctttaacctttctgaataattaggcgccttaagttcttcttgattttcagctgccacccactctcacacatacatgctcacacatatagagagccacacacacatttatgaccacacaaaatcataccaggagctcaccataaatctaagaaaattcctaatttcaggatcaataaccttaatttccctgcaaacgtttgtgtaatgcaatagcagtcaacttctttttaaaaatactgattagattaaaatgccttctagctgctttcactacagctaggaaaggctgagaattctggcggggggtcttaaatagtggtcccctttgctttaatgaagaactacagttttaaaatcaagcctttgaaagaggaagttctgtgcagccttacaccttcattaaatttgaaagcaatttgccaccctgtgaaataaattattgcactttctacaataaggaacaaaaggaaatatagttataatgcttttaaaagcatcctttggtgaaagatgcaatggaaacaaagcctacaatcgaaaaatttcgttaagaaggggattcctttggtattctagacatcggttaaaatgtcagtgccctaatagtatgatcgttccatgagcttaaaactgttttttttctttctgtttccatctattttttaaaactgcatctaaacgtagcaagcttgtgtgcccaccacccaaggcaagccgaacccgagataccattttccgtttgcaggggcctggagatccacacgagggcgcgctcacgttccagaagccgcgtttgaccaagaggccgcggtaccttgtctgtccaacactggattctaataggcgacctcaaccccttagaaacaggcggcagctaaggtgtttgctagtttatttgttctaagcagccatgaggtgtgagaagttgtatagagacagaaaacggagcaactagattcacgaaacagcctaatctttgtctctttaaagacaaagctgttgcaaaagaataccttggtataaccagatggtgtggagcagagttttaaaagataaatgtatgcattttgaaagataccatagccactgctggttaattaaattagggaaaatcagttttcttggtttcagtgtggagagccttgtctagggttggacaccccctacttaacatccccctcccccccgcaaaaaaaaaaaaaaaaaaaaaa

SEQ ID NO: 403516 - DNA, 1915 bp, Homo sapiens
  misc_feature (292)..(292): n is a, c, g, or t
  misc_feature (1417)..(1417): n is a, c, g, or t
  misc_feature (1487)..(1487): n is a, c, g, or t
  misc_feature (1667)..(1667): n is a, c, g, or t
  misc_feature (1672)..(1672): n is a, c, g, or t
ctgccgagagtgtcttcagcgccagcatttcctggcctaattaagctgggtaatgagtagctaagaggaggggataaaagccctaggcggcttagagctgggacagtttatgacaggggcgtctgcagctggtgacattcctaggaaaattatttctcataaccctgggaagttgcatgctgtttccttagcagcagagtaagcctcaaaggacattctgattgtcataactgcgggaggcagacaacttgctacttcacctggagagtagaggctgacgatgctgctaaanatccgacagtgcacaggacagcctccaaaacaaagaaatatctggcgcaaatgtcagcagtgctgaggatgagaagccctgctggacaaatgggaagaagagctctgcccgctgattcctcctggcagaaaagttcccactgggctcctctctaccctgcccagtgggtctgcagctgttttgtttccaggagcctgagagagagacagaagcagctgggaggagaaaaatcaacgcggccaggggccctactggtccttctgccttagccacaggttctgaaaccaaagcaaaaccaccagagagtgattcatgtgggtatggccctccctccccctgcccagaaaggtttctcttgagcccatatgctagtttctgtcatgcaaacgccctggcaatgccttccttgccttggcgcaatggctctgattgggtaggcatctccgggggttaatactggcacaaactcatgtaaatcttcctgggcctaagtctggtgtactctcatatgtgaattggcatggtcctggagggctagtcagctagctcctagcctcgagatcggcctggaccaaaccaaaaaaaaaatcatctctggtgaaacaggatagccaccccaccccctgctcagcattccccagtgcctcccttcacagtggccagtttggattcttctcaccaaacgctcaagacctgtacaggttacttattggtccccttcatgccccagatgcaaatttggcatgtctcatttgcattctaaagtgtttggaggcaaggctgggatgagcttaatttgccctgatgtcttttgaccaggttagtaaacatccctccagcccatctcagcacttgagaatctggaaggcagctatgctttaattacagtgcaatttcaggagtttgcttgctgttcccccttggctctttgcctagcttattattttcatcttgttgtttgtttgtttaaatgagaactttcgtagacaattccctctcccgcctcccccagaggccagtctgtgttgctagaggactttttctgcctccctcttggtttacaaagccagggcatctctgttgacaaagggtctgcgatctggcactgggcctggcagttagggngtgtgtaagaaatgcagatgccttttgcagatgcctgccctgctcctcctctaagcagccaaaacatccngcaccacctcgggaagaccccacatcccagcttgctggtctctgagcactctgccccgccaaccctatagcgctaggaaggcaggaaggatggaaaaggctgtgggggattgagtaagggatttgggaatgagggacagtgacactgtaggtgggttggcttagcagggggattgggagnggccngctggagtggtggaaagaactggggacagggagtcaggaagctgagcttttattcatcccagctttgctactgacaagttaggtggtcttggggcagactgggccaaatctgggccttcctgtgtaaaacgcatgctcccatctcaaggtccttttctactttacagattctcttgcttttagaatgctaatttcattgactgtggcctgtttccttctccagagacaggataacccaataaa

SEQ ID NO: 403517 - DNA, 362 bp, Homo sapiens
aaattataaaatagagtgggtcaattcaaatgaagatatatatttaaaaatgaaataagaaaagaaaactaagtctcaaggaaattataaaattcttcaacaaattcttgtgggcatctcatgttatagaaagaatagtggaacatagagtcatatcctagagagaaaaaatttcccccacttaaaaaaaacacacacatttaacataaatcagttgaacttaattcattaggtgcagattctcttcaggacctctgaatttaaaaaatgagtacattcataacttgaatttacatcccattatattaaatcttcatgtccagtataaccaaaagcaagaatactaaaagttctttagcctt

SEQ ID NO: 403518 - DNA, 964 bp, Homo sapiens
agcgggtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaacggagtctcgctctgttgcccaggctggagtgcagtggcgtgatcttagctcactgcaacctttgcctcctgggttcaagtgattctctagccttagcctcctgagcatctgggactacagccattgctgtgaattacgtgagggaaagatattgaagaggagttggacactccgagagtgcagctgttctccccccgcaccatccgtgtcctgcattctgcgagtctgtgctcattaacaatgtgctgtgaccatgtgactcagcaatcctgctgctgggtatatacccgaaagaaaggaaaaggaagccagtatattgaagagg

SEQ ID NO: 403519 - DNA, 310 bp, Homo sapiens
agcgggtgtgggcggggcgcagttgggggagggtgcagagacctgagggcttgaggttgcctggctggccccgctcccagaggcgggtgccgcgctgtcgcccagccattgctgtgaattacgtgagggaaagatattgaagaggagttggacactccgagagtgcagctgttctccccccgcaccatccgtgtcctgcattctgcgagtctgtgctcattaacaatgtgctgtgaccatgtgactcagcaatcctgctgctgggtatatacccgaaagaaaggaaaaggaagccagtatattgaagagg

SEQ ID NO: 403520 - DNA, 842 bp, Homo sapiens
agcgggtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcaccattgctgtgaattacgtgagggaaagatattgaagaggagttggacactccgagagtgcagctgttctccccccgcaccatccgtgtcctgcattctgcgagtctgtgctcattaacaatgtgctgtgaccatgtgactcagcaatcctgctgctgggtatatacccgaaagaaaggaaaaggaagccagtatattgaagagg

SEQ ID NO: 403521 - DNA, 1150 bp, Homo sapiens
agcgggtgtgggcggggcgcagttgggggagggtgcagagacctgagggcttgaggttgcctggctggccccgctcccagaggcgggtgccgcgctgtcgcccaggtatctggggtctctggtgtctgagtgtctcattgtcggcgcgaacacaattgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacattctgggcgagcggcacctggtgacctgtaagggcgcgacggtggaggccgaggcggcgctgcagaacaaggtggtggcactgtacttcgcggcggcccggtgcgcgccgagccgcgacttcacgccgctgctctgcgacttctatacggcgctggtggccgaggcgcggcggcccgcgcccttcgaagtggtcttcgtgtcagccgacggcagctcccaggagatgctggacttcatgcgcgagctgcatggcgcctggctggcgctgcccttccacgacccctaccggcacagccggagccaactaatacatgcggccaccttctctccatgcctgcactttctgttccaagccatctggtggaagcaatccaattgcctgcagaatcatccgaaagcatcactgggaagaagctggtggaactaagaagcaattctttagcctgacagccagtctgtttttagtatttctaaacatgaaatcatctcagaagaagccaagggctgtcgaggtgatttgcctgaggtcctacaactcatcactgactgtgtttggaggaaggaagtaattaactataaatgtgattataagggtggggccttaatctgataggaccagtgtccttataagaacaggaagtgtgtgcgttcactgaggaaaagccatgcaagaacacaaagagaaggcggctgtctgcaagcctggaggagagctctgcctagaaactaatcctgccgggcatcttaatcttggaattccagcctccagaacagtgagaaataaatgtctgttgtttaaactac

SEQ ID NO: 403522 - DNA, 585 bp, Homo sapiens
gactcaaaaagaaaaagattagatctcttacttgactgcacgatccaatatggttgcactagcacgtttcaggtggacagtggctactgtatagtgcagatatggaacatttccatcatcacagagactgttattggacagtgctgccttagagacgtgggctgcaggacttccacaagaaggcctggatatcagacaccagcattcaaatttcttcccagtgctgtggaatgtggtagacccttggaagtccagtatctgaacatgctggtcaccaccgtatactagtgaccagaggatgcctttcttcagctgcttggcattctgccagcatgaattcctagcacgggaaagatggcaggtgatctgaattacttggggttatggtgtatttgagtgacctcactatatttgggaaggcgctggaaaaacacgaaaagaatgttagaaagggctggaataaaactacaggagtcccctctttatccacggttttgtttcccagttttaactactcatcatcaaccacgatttgaaaatattaaatgggaaaattacagaaataaacagttcatttattacata

SEQ ID NO: 403523 - DNA, 904 bp, Homo sapiens
gcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccaggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctggagagattgaaaaagaagagcaggctgctgctgagaaggcgtgaccaggaggaatttcagggtgaatggactggtcccgctctgagttcactgctactcggctgaggttgcagactgtctgaggtgtccggtgcctctgtgctattagattcctactgagactggagcgctcagcctgccatagaagactggtctgcagctccc

SEQ ID NO: 403524 - DNA, 433 bp, Homo sapiens
gcatatcaggatccagaaaagtctcatggatctactcaatacataaaaccaccttttgagccaaaggactacagcctggaaggcaggagaggaagtgctaattgatctgtactccactagaggcagcagggtttgcacatgcaacaactgcagcagaacattacttcctagtgagccttgaccagtcctaaaaataagggtcatatgaaataatgaagtcttacagttaaaaaggacctgaaggctgtgtgcggtggctcacgcctgtaatcccagcactttgggagaccaaggcaggcagatcacctgaggtcaggagttctggccaacatggtggaacctcgtctctactaaaaatacaaaaattagccaggtgtagtggtgggtgcctgtagtcccagctactcaggaggctgaggcgggagaattgctt

SEQ ID NO: 403525 - DNA, 340 bp, Homo sapiens
tgagacagagtctcactctgtcgccaggctggagtgcagtagtgcgatcctggctcactgcaacctctgcttcccaggttcaagcaattctcctgtctcaacctcccgaatagctaggattataggcacccaccaccacacctggctaatttttggtatttttagtacagacaggttttcaccatcttggccaggctggtactgaactcctgacctcgtgatccaccctcctcggcctcccaaagtgctgggattacaggtgtgaaccaccgtgcccagcctgtagaatggaatcttaacaccaatctgcccaagcacatgtttatgttatctcaaaaga

SEQ ID NO: 403526 - DNA, 339 bp, Homo sapiens
ccctaagcagcaaagaacagcagggaccaggaaacaaagtgacccatagagcagctttgaaggaagacgaaagtcctttattaaccccccccgggtatctcagaagccctttgcaagtgaatggttgactttcgagggttgcattcacctttattattatttgcaactgctatgaagaataactggagggattatagcaaaacaaagagaaaatggacatttctccaagtcaaaatagaaatccacatattaagatggcatcaggtactgcgtggcatccttgatccaggtagggttttactggtgcaacatctttttggtgaaccctacctgcagaca

SEQ ID NO: 403527 - DNA, 226 bp, Homo sapiens
cattttcatcatagtgctagtcagttcttcgaagtgataacttacatgtttataagtcacattagataaaaataaacaaatctcactttggacaagtcaccacaagttatctgtgtttttttttttaatctgtaagatggtaatagtaaaataatacttgctctacctatttcacaggggtgttgtgaagatcagaaacaaataaaaatgagaaagcatgtgtgta

SEQ ID NO: 403528 - DNA, 377 bp, Homo sapiens
tgaatgaaagatgagtagcgtaaaatgaggtaggagaaggagatcatggcagatgggaggcaggatagatcgcagctccaactcggatggacagagcaatgggcagaggcctacatcgtgaattttagctccgagattgattgcaagaatgaaccagaaatccagagaggacccacagaccctctgaaggaaggggacttctcttgcagcacccaggagacacccaaatactgtgagtgtcccagctgcagaagtggggaaatgagatcctcctctcccaaacacacacccccactggggaaactgaaggtttgcttgttggagaagtttctgaccttaactggagctgagtcaatctagagagtccagtgaaatac

SEQ ID NO: 403529 - DNA, 457 bp, Homo sapiens
aatagaaatgagaccaaatttggggacctcatcttgccaaggaagaattgtagaggttaacctctcatgtggagagggccttgattaggatgcacctcagaggtgggcctgtgtgggtggttctgcttgtctgtggggcttgctcttgggtgcttcctgaggtgtggttgcacagggtggttattcctgaatgcaagggcttactatgattttctcttagtgcctctcatttctgatgctttctgtcctatgaggtcagtctacttactagttagtattctatattaataagtatgccaaatgacttaactcctccagaaatgttattcgttaaaagatgagatgtgctgagacaagaggatcgcttgagtccggaaggttgaggctgttgtgtgctataattgggcctgtgaatagccactctgttccagcctgggcaacatagtgacacccgtct

SEQ ID NO: 403530 - DNA, 433 bp, Homo sapiens
aatagaaatgagaccaaatttggggacctcatcttgccaaggaagaattgtagaggttaacctctcatgtggagagggccttgattaggatgcacctcagaggtgggcctgtgtgggtggttctgcttgtctgtggggcttgctcttgggtgcttcctgaggtgtggttgcacagggtggttattcctgaatgcaagggcttactatgattttctcttagtgcctctcatttctgatgctttctgtcctatgaggtcagtctacttactagttagtattctatattaataagtatgccaaatgacttaactcctccagaaatgttattcgttaaaagatgagatgtgctgagacaagaggatcgcttgagtccggaaggttgaggctgttgtgtgctataattgggcacaccttactggacgggtatcctcta

SEQ ID NO: 403531 - DNA, 492 bp, Homo sapiens
tcggctcaagccatcctcccatctcagcttcctaaagtgctgggattacaggtatgagccaccataccaggccacaaaggaatatttaaccatttgaattaagctttgtatcattgcatccttagaattataaaggtgttagaatttgcctgtgtttagcaaaccaggaaagagagtatggatttagaaaaaaagaatacaggaaaaaaccttaaaaaccattctattattcttaacactgtcatttttgatagaatcaatttcccataaacaaagtgattgaaatatttatttttgttgtgtaattgtgtgaggcctttgatgataagtggcatttcttgatcatgtttaaatcctccagaatctggggctttgactgtaaagtataagacagaagtagaaattaccttcacagttacctgacacgtatacacctttattcatgaaacattgggtctggacatgacattgcatcaggccgtgtggatttca

SEQ ID NO: 403532 - DNA, 719 bp, Homo sapiens
tttctgtagagccggcgttttgccctgttgcccaggagtttttcctttaatgttctcctgctacttactaattcactttgtcaccctgtgagctcataagagcagagagatagcaacaggagctaaaaaaactctaagctgtgaaaaaatattaaatatgaaatcatgatagctattagcttaatttgttttaggcaaattgcaaagtaattttttgggaatcagtgtcccactgcagtgattccatatggggattcctaattcccagtatgtttttaaaataatttgtaaacacctagtacaaacgcatgatatgaaattcaagaggtgggaggatcacctgagcccaggaggttgagacttgcagtgagctgagttcacaccactgcactcgagccttgatgacagaatgagactgtctcaaaaaaaaaaaaaaaaaaaaattgtccttaagtccatgtggacccctgactaggtttgtgccctagacagccttcctctgagggcagttcaggtggtgagactccagctttaaatggcctctagagaaatttcactaacctgccttggtgtttgaccctgtataacccctttcttctggaggtccctttgggtggcagtagatacgggatttggtgtctgacagctctggggacagatcccagctccaaatggcagagtctctacagattacaagccaaatacttagcactatgtgc

SEQ ID NO: 403533 - DNA, 684 bp, Homo sapiens
gggctcatcttgcttttgccctgttgagaggggccaagggacttggtagagcagcaggggctctgacggtgaacctcattgtttttaaaattattcataagaggccaggtgcattggctcacacctgtagtcccaggactttgaggagcagaggcaggaggatcatttgagtccaggagttcaagattagactgagcaacacggggagacctcatctctacaaaaaatttaaaagaaaattaattgggcatcatggcacgagcctgtggttcccgctactcgggaggctgaggtgggaggatcacctgagcccaggaggttgagacttgcagtgagctgagttcacaccactgcactcgagccttgatgacagaatgagactgtctcaaaaaaaaaaaaaaaaaaaaattgtccttaagtccatgtggacccctgactaggtttgtgccctagacagccttcctctgagggcagttcaggtggtgagactccagctttaaatggcctctagagaaatttcactaacctgccttggtgtttgaccctgtataacccctttcttctggaggtccctttgggtggcagtagatacgggatttggtgtctgacagctctggggacagatcccagctccaaatggcagagtctctacagattacaagccaaatacttagcactatgtgc

SEQ ID NO: 403534 - DNA, 486 bp, Homo sapiens
cactgccatctgaggagcaagttctttgacaggtgggggaagcactgacttcattagctcgtgtgagagtgaaggggggagatgtccctgggaacttctggcagccttgagggaaaaggatggtgacgttgtgtttcatattgaacttggcatacatgggagtgatgggggtgttcataggagatcagatggcacttccagtttgtctgcaagagcctaattactgacctgacacccgtttcttcaaataggcccgggaagcagctaactggtgtatggaagcatctggtagtgcaattaccctgtcagctctttatccacttgtagccctgtcattagacacttcttttccttgatatgcttaaaatgtagagttaccaaccagagcaatttaaaatgatatatagttatttttttctctcctctcctgtcgagggagaacttcataaatgatgtcacaataaacggaatgtgagagaaacctca

SEQ ID NO: 403535 - DNA, 231 bp, Homo sapiens
tgataccacagcttcttggagtgaaacaaaagatagtttccagaagataataaagagactttaaaatcagtgtgctatcttccttccatcagtgtccccctggttgggcccttagtgcaaggagacagtaataatagatagtgcttctgtcaaaaggtcgctttcttctttccagaaatagaaacatgcttcccaagaaataatctaaatctatttatatttctgccactt

SEQ ID NO: 403536 - DNA, 593 bp, Homo sapiens
taagtacatgaaaagacagtattgcatagtggttaaatgcatggactctgaagccatcctgtttgggatcatcctggctacattgcttactagctgtgtgacaatggatataggtgcttaatgtctctgtgcctcagtttttgtgtctatgtaaaggagataataggatccccctcatgcctcatggtcttagttgaatgaattcatgtaactccacagttatcttaatccagaaggctcaaaatactaatgttttgtgtgtgtgtgtgtgtgtgcatgtgcatctgtatgacaagtgatataaaacgtgacctgaatttataatatgaatagtcacattttgcagcagaaatattaaatgtttaattatagaatgctagcactgatcctgctgaaattgttacaaaatacagcagttgccccttaactgtggcagatacattccaagacccccagtactgaatgctgtatgtacattttttatacatgtatacttatgataaagtttataaattaggcacagtaagatattaataatagaatatacaatataccgcaataaaacttatgtgaacagttatttttggacagca

SEQ ID NO: 403537 - DNA, 442 bp, Homo sapiens
agttctgtttgatctgccaaagagccagcctcagtccactgagaaacagggatgtgccgttatctgcacactgaggtttatttttaccttgtccctggtgagtccccagagacaaggagaaaacactttgggagggagttaagagccttttgcttatccttgaaggaaagcagtctctgaggattagtgagggtggtggtgagggtaggtagggggaggagagtcagaggaatcagagttatttggactgcattttttccttgcctgattaaatcttactgacattggcactttgtgtcactaaaagaacacagccctggatgtggggccagggaccagagggttggcggcagagtctggggctggcatggctgctgggctgcttggctctgaggacccaccgtggagttggaacctgacttgtcgggcgctgaggacctgc

SEQ ID NO: 403538 - DNA, 420 bp, Homo sapiens
acattctcaagttataagaagttagttcttcttccctcatgttacttaagatttgaattcatgattgtatagaatcattagttgtcttaaacaagcaagggcactaaatgaatgaccattacagggaagacagtagattccatgagaggatgtgtcttgagaatgtatatgaacatgaagacttcatctttgagaaagaggaataactttcagaggaaggtgattcaagtgaaccaagacatgacactgaagaagaatggtgggggtggtagggagtaaaactatcgcagctgtgtgtacacaaaagggaatgaaccagggttgggagtgcagtggtgtgagttgtgacttgggcctagaatgcttgattgaacatagcattactggctttgctgtcctgagtgagtcagtgggcagttg

SEQ ID NO: 403539 - DNA, 377 bp, Homo sapiens
gtggagtgtgcaccaaatttcaccgtgtaaaaatataccattatagaccttgtaaaatataccgttacaccatgctggctgcaacctggctgtaccattaactgtaatcctgctttgttttcttggagtaggagaaacaggcaaagccaaccaagatgcttttgattcccagtagtactgttaaatagaccagcgttgcttagaaataggtgtgggtctgtctacttcagatgcaaaggataaatgcagtgggtgtcacagccacaataataattatgtcatctgtcttgtcatggaatgtgactatagtaattgcggcattttctcccatcattgaagcttgtaattatagtgcaactaacaggattacgtgctaa

SEQ ID NO: 403540 - DNA, 442 bp, Homo sapiens
ttcaggttgggtacaagacttagtttgagcagggcctgtagttttccttccctcttcgtactgggtgcaatcaaaaacccaaagacagaagagatcaattacaaaagcaacagtaagtagccttatttgggccatttcattaagaatgtttatgtttttacttatctctttaatttgcatttggaaatccaataaaactagtttgaaaattattgaaagtgagatttttttaatattgaaaactctttaaatattgaaagtggtactttttttctttgtgtaatttttttaatggggtcttctctgcatgtgtgtaattttcatgtcacttaggaataagcatgcatatactgatacttgtttacatgcatatggaaattgcatttttttcaaaactttgtgttgttttttccctaattttgttaatccagaactcttacag

SEQ ID NO: 403541 - DNA, 204 bp, Homo sapiens
agaaaaatcaagtcccttagcacattggaagataaattcagttaaccctgtttccccagggttcaacaaacctacatcacttaattttcatttattttctaacttatttccttcttagagcatcttcctctctgtcaatacttcctaataatatatataagagccagtcttattccggagttacttatggatcattctccagaa

SEQ ID NO: 403542 - DNA, 268 bp, Homo sapiens
agggctgctcctgtgactggcagctttccagcttctatccatgtatatatgtacaagttctgctgcacaaaacaggaactctgcattagtgacttagcccaaagggggtttgtagtcttcacataacaagaagtctgcaggcaggcggctcagggctggagcagcagctccacaacatcaacaacacaccaagctgcactagctttccacttcaccatcctggacaagcagcttttctcctcatatttgccatctcacagcctccagc

SEQ ID NO: 403543 - DNA, 385 bp, Homo sapiens
gcccccaagaagggctttttaaaaaaaattttttattttgaaattttttcaagtggtaagtttgaagaataaaaaaaaacttttatgtacccgttacccagattcaccagtttttgacattttgataatttgcttgcatcctttatgtatgtatatatgtatacatgtgtatatgtctgtatttgtaggtacatagatttgtgcacacacacacggttcccctgccaacccagtcaagggtagcttttatgagtgatgctgctgtattccttaatgcttcaatgtgtatttccagagaacaagaatagtctattatggatctgtagtacagcattcacattcaggaaagttactgttgtttgtttgtttttttttttttttagcc

SEQ ID NO: 403544 - DNA, 486 bp, Homo sapiens
gttgcagtgagccgagatcacgctgctacattctagcctgggggacagagtgagatgctgtctcaaaaggcaaaggaccagatagacatttcttaaaagaagactggccaaaaggtatatgaaaaactgcttaacattaaggcttaacactaatgatcagggaaacacacttaaaaccacaatgagatatcatattacaccagttagaatggccgttaccaaaagataaatgataacaaacgttggctagggtgtggagaaaagggaatcacagagttagtaagaatgtaaattagtacagctgttttgaggaacagtatggaggttccttaaaaaactgaaaataggccgggcgcagtggctcacgcctgtaatcccagcactctgggaggctgaggcgggcggatcacgaggtcatgagtttgagagcagcctggcaacatagtgaaaacccatctctactaaaaacacacacacacaaaaaaa

SEQ ID NO: 403545 - DNA, 178 bp, Homo sapiens
ctcccaaagtgctgggattacaggtgtcactgccccttttcatagccaatattttgtaatccttcctttcccacctgaagtgaatgtcatctatgctataacctacccataatgtaatttcagaaaatcactgtactatcccaaaggcaatgaaaaggagaaataaaaggaaagtata

SEQ ID NO: 403546 - DNA, 534 bp, Homo sapiens
tttacctggtttcacaggttcacagctggagaggaatgttggctcagaatgaatcattcctggtcttacttgtatctgatttagatgatataaaactttggactttaggcttcagaactgatgctggaatgttttgtcttttaaagatgttgagatggaatgaatatattttgtgtatgagaacatgaattttgtgggttcccgggcaaaatattatggacttaatgcttgtgccccctgctaattcatatgttgaagccctaccctcgaaagtgaggcgaggcctttgggaggtagttagggttagatgaggtcatgatggtgagccccccatgacgtgtccttaaaagaataggaagagaccagaacgtgctctctctttctttctccccaccaagtaagaacactgagagaaggtggctgtctgcaagcccggaagaacaccctcacatgaacattctggcaccttgatcttagatttcccagcctccaggactgtgagaaataaatgtctgttgtttcagccaaaaaatc

SEQ ID NO: 403547 - DNA, 239 bp, Homo sapiens
tccctctttcccacccccacacctgatacccagcccctggtcaccattgatctactcgctacttctacggggtcaacatttttcgatcaagacttccgtaacttcatgtggaatttgcctttctgaggtgatggagatgctaagatttgatcattccatggtgcacacatctatctaatcctcacattatatcccataaatgaatacaagcataattttccaattaaaaataataatta

SEQ ID NO: 403548 - DNA, 382 bp, Homo sapiens
aagatataaaacagctctttttccaaggcccggagtactggggattgatgtttcaaggccaatcaatgggatgcttcgttttctccagcaacaggaactctctcttttcacctttgctgccaggaatctcagagataatttagtgctcaatttactaaccttacttcacattcaggttagatgttacctccacctatatgatagtaattcctaattttattttttattgtcctttttatgagtgtttatattttaaagtactttgggtatttttggggggggtgtaaatgagtgatcagtgtacattgtgtgtggactgaagtgtaggtatgtagagatgcttcgccaaacagatgcttaaaaatgaatggaagttgagggt

SEQ ID NO: 403549 - DNA, 494 bp, Homo sapiens
ccaaaaggacctagttctgtaggtcctttgcacttaaagcaaaaatgcaagcaagtataggaaaaggtggttctcttcccaaagtagaagccaagttcattaattatgtgaagaattgcttctggatgattgatcaggaggctattcaagatctctggcagtggaggaagtctctttaggaaaatagtttaaacaatttgttaaaaattttccatcatttcatttctgtaacagttgatatctggctgtcctttttataatgcagagtgagaactttccctactgtgtttgataaatgttgtccaggttccattgccaagaatgtgttgtccaaaatacctgtttagtttttaaagatgcaactccaccctttgcttggttttaaatatgtatggaatgttatgataggccatagtagtagtggtggtcagacatggaaatggtggggagacaaaaatatacatgtgaaataaacctcactgttttaaattaaa

SEQ ID NO: 403550 - DNA, 363 bp, Homo sapiens
aacctgtcctttccccattaaatggtcttggcattcttgtcaaaaatcaggctggagtgcagtggcatgatctcggctcattgcaacctccaccttccagattctcttgcctcagcctcccaagtagctgagattacaggtgtgcaccaccacgcccggctaacttttttatttttaacagagacggggtttcaccatgttggccaggctggtctcgaactcctgacctcaggtgatccacccgcctcagcctcccaatgtgctgggattacaggcatgagccaccgcacctggtctgatcaagtttaagactgcattgcaccacagcactgcagcctagacaacagagcaagaccctatgtc

SEQ ID NO: 403551 - DNA, 377 bp, Homo sapiens
tttatggtctaaaaaaaaaaagtttcataaaaatggtggatgacatttacaatgaaatagagattttctttccttttaattatcctctcagggtagaggtcaggaaaggggtgaagaagagagaaaatccaggcccattaaatctttttcaagcctgctgcctgggtttgattcaagttcactgctaattccataagctgggatggatgccaaagagaagtccaaatcctatccgtgcgtcccctttgtaactggttttggaactacaagtcctagtctctgaaatggcctgtttaacaagaaatcaccccagaaatgtctttatgtaaaacaaattagtacacaatatattgccctcatattcagtgtgcagaaag

SEQ ID NO: 403552 - DNA, 402 bp, Homo sapiens
cagttccataaatggctgcctacagaggaaagcttcacatgtgcctaaaaactcccttcagatcgtcatcagcccgtattcagccacaaggaggtctttcaatctgaaactccagagatattaatatctatcgctgtacaagccagcccagttctgggaaggaaggaagggaagggaatgtgtgaagacaagagtgagtggtgggtggggaggactgttctgtgcatgttcctatcactttagtagctcatcaaagagagcaaacgtcagcacctcttgatttggttttgactcccccagatttctacaatttcagattcttgttttaagtgccagtaaaaccttttcccttggggctagggaactgtgcaaaggaaataataatactggcagagtgatttg

SEQ ID NO: 403553 - DNA, 451 bp, Homo sapiens
tgtgacctcattttaccttaatggactctctaaagaccctatttccaattacaggcacattgaagattagggcttcaacatatgaatttggtggtggagttgggcacaattcagtccacaacagtgacttcactttatggtttaatccagcctccacattttacaaatgaaggaactgaggttgggaaatagaatgtgcccagcaaatcagtgacagaggcaggtctgtggccctggccctaatcatgccgtccttctgcctttctttttcatgttttctttgttttcttcagcttccattcacttagtacataagcaaaataagacatgcaatgcatttatttccatcctcataccctcaagaatttgttaaacatagagaagtcagttaaacattacctgaaatatactagcaaatataaaactactgggaatattagtggtgttaaca

SEQ ID NO: 403554 - DNA, 369 bp, Homo sapiens
cagggcctgggtttcatcatgagtgctaacactgatagaatgagtgtggttgcgtgagcactgtgttgagaaggattctgaggcatcatctgagcaagagttccatggttgattagccaagtgtgcagcaggtacagaagcataaatggtactatttttttctctcttttttgccatccctgccctagacggaacccagaaagagtccagcctagttacagactcacctctgaatgaatcaaactctgagccccatgttttcctttttttaccctggctgccaggaaactcagaagcaacattttaaatattcacttattgttttctgctgctatggttatcaggcttacttttctatttacttttcca

SEQ ID NO: 403555 - DNA, 410 bp, Homo sapiens
tattttggcaattttactattttttaaaattcatacctagtttgaattgagattcatgtaagtgaaacaccattaataaggatttttagttttaaattttagtttgttttattataaaatagtcaatatctatcattcttaaaatcaagtattctttatagtagtcctacttaatatgcagtctgtaggctggaaagcatttgttaccagtctgccttgaaattaaatatagaagttgagtaaatgcttaaaactgtcaccaaagtttgatagagtaataaaaatagggggcttgtattttgtttttgtcaaatttgacttgattatacaaatgtgatgaattagaaatttaaaaaaccaattggtccttcccacagaaggatatttcatttgagaaatatcactttaga

SEQ ID NO: 403556 - DNA, 660 bp, Homo sapiens
gccatgcattagaccgcaggaagaacccactgaagtcaggctctactctttcgacagggactgggaagatcaggagtgagctccctgaatgtttgcattgcaaagagaaggctctcaggtcctcaaggaaatggggttgggtggtagattcacatcccaaagggcagagaaagtgtttatcattgcaggcttctaaagtaactgctctagttgggttcggggacctggctgcttgtctccaggttttggctggagcagagtaaattgtcctggcagggttgagccttcccaggcagttatgttaaggatactggggtcattctagggacacagccttaagctgctagaagcaatgctagagattggtcgagtccctgagtgcagaggtttgggaagagttgttatgtgcgtagagatgtgcagttcgcccctcagaaggatttcagaggttataccaaagaccaaagccacgaagacaggatttaaggatttcagtgtcatctgtgacaggtgggggtactagggaggtctacatcctcttccccagagccctctattccacactggcctggcagacaccttgcatctccatgtcactgaccactgtagggatcccagccacagacacacacacacacacgcgcgcacacacacacactg

SEQ ID NO: 403557 - DNA, 485 bp, Homo sapiens
tttttttttctgtcctcctggcgctcagctctggcacatacagttgcaaccataagaagcaggatcagggcagcaaacacaaagctccagttttttgtctgtagaactgaaaggcaagctccaggaaagcagaaagtcctggagaggatcctggaaagggagatgctcgaaaaatagaacacaaagttgttcaagaactccagggctccccctagaggcacacatcactgtactcggggacaaagcactgcccacatacacacgaccacaggaggtgcacgggcaggacagatcaaaccgcacaggctttgaagacatcaacccacagaagtcaactaggctgatttccagcttgaaaaaaaaaatcaacattcccctagtatgtaaagaagacctgaagtcatgtaacatagtcttcaaaatacccaggacaccatctgaaattacggggcataggaagaatcaagtagcatgcacatgaaaag

SEQ ID NO: 403558 - DNA, 332 bp, Homo sapiens
aaacataatcagtaaaagttacataaaagaggaatgagaaaaagaagtaaaaagtagagtcttcttcatatgttaaaagaatttgttgtaaagcctcagaatggcttctacatagtaaaccctccaaatctctccagtaaagattgtaattgcggcatatacacagtatcagacccaattagaaattgttaactagagaaaaacaatctggcagtggcttagtcttagcatggctttcagagactccagcacatttatggtattcttccctataatctacaccttcattctgaagcattatgatcaagacaaagaggacagtctacagattc

SEQ ID NO: 403559 - DNA, 492 bp, Homo sapiens
ccagcttcagacagcctgtggacatggctccctggtcagcaggagagcatgttgcatggggatccctgggcaggcactgggagggaggcctgaggtgtggctcctgcagcgtcatagctactgctctttcctgcagtgacaacctgtccggcccactgagcctccatcccagtaggccagcaacaccctcaaggctaagaagatcaggccatgaagaatctcagggccaatgagtgcccaggtggtaggtgcagagtgcctcagggctcagtgaagtttgggctgagcacgggctctggacttccaactaactccactgtgactagcactgtgattggggcagcctcactgctctggaacttgaggtaccattgtcacagatataaaacacccttccaatcttttttttttttatcttcctctgtaatcaccatgtactactgctctgttagtgtttttattcaaattaataaacatatgttatacagtgta

SEQ ID NO: 403560 - DNA, 407 bp, Homo sapiens
gtggagacagggtctggggtctgatgcggacaggacagatggatgattggggccccccgacatgacctcaccattcacccctaaaacccagggccagagcctcctccagagcccggggaaaggaggggtacgatggtggggggcgaaaggtcaggagatggagcataggccttctcctccccacctttgtcccctccggccctgggccacctcaaacctcctgcagatttttccctccagaggccctcatccatcccctcctcctgaccatccaagcaggagtcaccatgtctcccagaccccaggcagcttccgcttcactccctccccttgctcccagcacccccaccaggaccccaccaccccaactccagccctttctgggtccctcctctcctgatccccag

SEQ ID NO: 403561 - DNA, 412 bp, Homo sapiens
aaggcgcatacctcaaaataataaaaagccatgtatgacagtcccacagccaaaattatactgaacagagaaaagtggaaattattacccctaagaagtagaacaagaaaatgatgaccttttaccccttctactcaacatagtactagaagtcctaagagcaatcaggcaagagaaataaagtgcatccaaactggaaaacaggaagtcaaattgtatttgatggtaatatgatcttgtacctagaaaagcctaaagactccttcagaagactctaaaatctgataaatgaattcagtaaagtctcaggttacaaaattaatgtgtacaaatcggtagcactgctgtaagacaacagtgaccaagctgagaatcaaatcaagaactcaattccatttacaatagctacaaa

SEQ ID NO: 403562 - DNA, 422 bp, Homo sapiens
agatgtaagaagtatggtgaaaactgagtttccctgctactcctgactccctgtacccctccccagaggcaacagttgttccagtttcttaggtatctttccaaaaagatgctatcgaggcacctctgccagcttgttctctctccttccaaagccaaacactttatttcagacaattgtgtatttaaaagtatccagttatatattaaatatgaaaagcaaatgacaacagtgtgtacaggatgtttccatgttttaaaataataatgtgttagaaatgcaatataaacccgaatggtaaatgatgcctaggttggggtgtgggggtgcacttccttcgggaaccactgcagtttaatatgtgaacttgtgaaaacaagagcatgtaattttttcataataaagaaatttttttaactaag

SEQ ID NO: 403563 - DNA, 502 bp, Homo sapiens
aaccgagaaaacctggctcctcctgcctctctgaccttccactacatcgccctcctctacccctcaactccaacaatgggccttcttcctctccctcaaaacgacaagttcttccctgtcccccgggtttgtacttgctgctccttcttgacgtctttactgaccaccccaaactaaaagccctgtcctgttactatctccctgtgtatttccttcaaggtgcattcactaacagcacttatctttttcacatgcatgtttgcctgcccgttgtcagtttcccatgagaaccttaatctattcatagttaatctatataaatatctcagtctatcatcaccttcaccactgtcactcagccaccagagctgagcatggcacagaatgggtgtttattaactaaattaactacatttaatttgccatctcagtaagtcacccagcacagctctattcagcttccccacttttgcagatgaggaaactaagaacatcaaggctg

SEQ ID NO: 403564 - DNA, 484 bp, Homo sapiens
tagaacgtaaactccacgggaacagggactttgttttgttctctgccgtatctccagcacctacaacactgcctgacaccctgctgggtgaccgatatacgccggatggctcagggagtgggtgcaggtcgaggaaagggtatagcaagaggtatgtccgggagggatgtttagggtgtgcttttagtccaacagaaaagcactctccatcctttttctatttctctcctctccttctccctccctccgcacttcagaggttggggaaaagctgcgggaaagcaggaaataaggaaaaatcctaaattgcccagctcgaattccaatgaaaaattaatgagcgaggaagacagggaggcagggaataagtgcacatgcaaaagttaaggaagccagtggaaagcaaagaaaaaggcgaacagacgtcactctctctggtcacgctccccgactccccagaggacaggcgaggcgcttctggcac

SEQ ID NO: 403565 - DNA, 358 bp, Homo sapiens
gcacccggggccaggagcggaagtccgaggggaccccacggcggaggagcggcagagcccgggccccgcgggagagagaggcgggagcctctcacactaacagttgatcggcggattccacttactgtgactatccagtctcctctaggcctttggacatctgaaaggcagtgttaagagcccaactctggagatggactttggctccaccaccaagtattaatagctctgtgacttggggcaagttacttaacctccctacaccacagtttccactgctgtaaattggggatgatgataataacagccacctcacaaggttgcctggagatttgattaaatgaaataattagcatgg

SEQ ID NO: 403566 - DNA, 384 bp, Homo sapiens
tggagaacatcagcatttaatgggtggagaaaggaagacacacccatgaacaacactgaggagtggttggacatcaaggagagaaggtgcttcagggaaggagtaataatgtcaagagtagagaaaaagacttgaaaagtactttgtttgctttggcagttaggttactgatgacttaagccttgacatccccagctcacacgatcctcccgcctcaacctgccgcgtagctgggactacaggcacacaccaccatgctgagctaatatttttattttttggtggagacagcatctgcccagcttggtctcaaactcctggcctcaaaagattctcctgcctcagcctcccaaagtgctgggattacaggtataagccactaca

SEQ ID NO: 403567 - DNA, 781 bp, Homo sapiens
aaattgatggtaatgaaggagggttgtgccatgaaaatacaagagatttcctattgtaaccttgttgcactgtggattaaattgaagatgcacagtggactcctggggatggaggagagtttggaggtcagagggctcttgtcttgagctccaagtggtgctctaagtctaggataaagattttacacagggtggggcaggtggacagccagatcttcatttattcttaccaagctcttattaagtcatgtgggtgggatttactgttaaggaaggcagagcctacctgtccccatagggctggcatcctattggaggtggcactagccacttaactagttaagtgagtgatatttgggtagggtgcccataactctgatacgatctgccttgcgattctgctcctgctagtggagtgtgggggaggcctggtcttggatcttgttcctcacagctggttcattcaggaggttagtgctctgctgaggaggctggaggcagagctccatcttggcctggctggctagtttctgttcaggactagagctagcacctgtagtcttggcaagccattttagaaatctaagttgttggtccatgtaatgtcctggtggttgaaccaacactcgttctttgccattcctgggcaggtgcttggagaaggctggtgagctgttcatgttttttgaagaatggtgcatcagtagcacaaggttttccctggttctgctgaggcctgttgctgagctttggggtgccctgtcccctgttttattcctgt

SEQ ID NO: 403568 - DNA, 788 bp, Homo sapiens
cctgctgtaatgacccctgattaacgagttgattctaaccctgctgtgcccagttcctctacctgagaagtgagctttaacaaagaaggagacaggctgcataaaattaaaacacctgattttgaacaattagctagatatggaaggctaatctttcagatcatctttctaaaaatgaaaaaatggactagatctctggtccttaaacttggccatccatcagaatcacctgcagagcacagattctggttcagtagctctggggcaggtcaagaatctgcatgtctgacactaccgcctctgctgccgacactaccgcttctgctgccgtcaccactgccaggtctgccccactcaatgctggtgctaccggtcagccagaaccacactgcatatccctggaaagggtgcttggttggaaggcctttgtgagagaaacagccttagtgtccctcgtgcataaactgaggataatagttgtctgctcgtgttatgtagatttggtgcgagcactaaatgacttaatatttgtagtgtttagaactgtgtctgatacaaagtaatggccatacaagtgtttttaagtaacagtaatttttagagtcccatgcctattatccacaagtaaactctagtcttatacctctagaacaaatgaaatcaacttccttagatacagctgaaatcctggcctgagttcagctgaaagcctgggcttagatggctggaaaacaaaataagaagtgtgaatgttcctcataacttttcccagccctggagcacagata

SEQ ID NO: 403569 - DNA, 448 bp, Homo sapiens
cagattggagggcaggaccactgagggtgtcatagacattagctctatggaattctgctagcaatttccaagtgacagtgaggaattatggatatatgttgaggtcattcagcttcctgagtaccacattccccagctacttagacacgggttaaaatattaagatgtcctagttcaacagcttgaattccattgattgatactgatagtgcctgtccaagacaccagctgaaagacttgttttgtgtacaaaatagttctgaaagtggtgagatacaaaaaggttttagaatcactgccctgttgagagaaattagggggaaatgattacatttagaagctgctagagttatccagtgtttgctggtctttgcaacaaactgtggagaatgggtggtatgtaatgctttggtaggcttcaatcactgataaaagatcatgttaaaat

SEQ ID NO: 403570 - DNA, 680 bp, Homo sapiens
ggaacatgatgcctgtataggaaagctgaaggcagaactatttttaggtctccatgtaattttttatctaagataatgatgattatgataataatgatggagtagctattactttttaagttcctactgtataataggcatgttataaatgtctcattcagtcttcataacaaccctacaagttacgtggtgttagtctcattttacatttaagttctgccctgattttagttatttcttgccttctgctagcttttgaatgtgtttgcttttgcttttctagttcttttaattgtgatgttagggtgtcaatttcagatctttcctgctttctcttgtgggcatttagtgctataaatttggccagggcaattaggcaggagaaggaaataaagggtattcaattaggaagagaggaagtcaaattgtccctgtttgcagatgacatgattggatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccactcacaattgcttcaaagagaataaaatacctaggaatccaacttacaagggtcgtgaaggacctcttc

SEQ ID NO: 403571 - DNA, 2017 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403572 - DNA, 394 bp, Homo sapiens
tcttcctgctgccacgagaagaaggatgtgtttgcttccccttttgccacgaccgaccgaccataagtttcctgaggccaccccagacctgcagaattgggccaacttgatttttctgaaataccttgaaagtttgaatcaaaaaatcagaaacaagtttttcttctgcgttaacagttccaaggagcagattattcattggtattcacataggccttgttttcaaacctggtacaaaccatgtcttcttggcattgtaattcatcaaatgtagtaccggccctggtacctgccattgcagtggcagccgcgtgcatgctgggctctcctggctcagctgctttcacacattgccgatcagcagcagcagcagtgaaggagaacttaagtggta

SEQ ID NO: 403573 - DNA, 2048 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggttaccctccgtctgcatgcccaccatcaaggcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403574 - DNA, 2089 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403575 - DNA, 1984 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403576 - DNA, 457 bp, Homo sapiens
ccctcgctggcgcagcatactcacgggtgtactgctgcctccctttcctggagagcccatctgctctccccactgtggttctttggattgtaaagatcaggtgacacagggagcatcaaataaggatgcatgtggattcgaactggaaagaagtcaggacctgagacagcgcaagggaccagcccacattctgtgtggtgactcccacggctcctccgcctctctttctctttcagctgccccaacacagcaggatctcactggactctgatgatggagtgtccaggctgggcagtgctggctccaaggtgattcctgctacagtcatctctggctagagaagcggaatagcaagctctttggtggcttttgtcagaatggtggggtagcaggaggcagtgaggtcagcgggcattatgccgtcctgtggcctggcagggagtgaaattggccatgc

SEQ ID NO: 403577 - DNA, 2123 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403578 - DNA, 1745 bp, Homo sapiens
tcttcctgctgccacgagaagaaggatgtgtttgcttccccttttgccacgaccgaccgaccataagtttcctgaggccaccccagacctgcagaattgcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403579 - DNA, 2120 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggttaccctccgtctgcatgcccaccatcaaggcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403580 - DNA, 2225 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcaggcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtctcacgagatctgatggttttataaagggcatttcccctgcacatgctctcttgcctgccgccatgtaagaagtgcctctgatcttcctttgccttccaccatgattgtgaggcctccccagccatgtggaattgccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaatccaaaacagaacaagcccttctgtggtatttgctttttatcagaaagaacagcaacatttggcctctccaagttggaaaatagagtccaaatgtaactttgtggccaagagtattttcaaaaaagtctaaaggtgtagtttccactgtaactgttgagtactgttaagtactgttaatcttttacatatttgcacttggtactgttgtattgttctaaagagcttgtcctttaagtaatttctttcttttttttttttttttttttgtgacggagtttccctcttgttgcccaggctggagtgcaacggtgcagtctcggctcactgcaacctccaactcccaggttcaagtgagtctcgtgcctcagcctcccaagtagctgggattacaggcacccgccaccgtgcccggctagtttttttttgtattttttttagtacagatggggtttcaccatgttggtcaggctagtctcaaactcctgacctcaggtgctccacctgccttggcctcccaaagtgctgggattacaggcgtgagccactgtgcccagcctaagccatttcttaaaataaaaatgctaaaggactagtaagtaaaaataaaacttcctatgggatttcccagtggaattac

SEQ ID NO: 403581 - DNA, 469 bp, Homo sapiens
ctttctgtacatcagttttctcatacaatggaaaatggtatgtcagttagaatgactttgctacacatagtaaagcgtctcccacagaaagattaaacaatgagaatgtttatactcttgcacaaaaattcagtgacaggtggtacttcagtgtatctgctttgtcctcacgctggctcctcttctgaccccacggttactccttttcaggcatcctgtgcaggtacaaccatgaacagcagcagaaggcctgtctctttccagggtatttgttaaagaataaagaaacctttctcagaaacttctcagcaaccttctcatcacctttcattggctagaatcttatctgttgttatgtccaagaatttcctttcaagggcaattgcaaaacaatgacctttcagaattacccctattgctgaaggatggagacatggagacataagttttgtatgggaagtaaacacta

SEQ ID NO: 403582 - DNA, 2014 bp, Homo sapiens
  misc_feature (1755)..(1755): n is a, c, g, or t
  misc_feature (1778)..(1778): n is a, c, g, or t
  misc_feature (1798)..(1798): n is a, c, g, or t
  misc_feature (1853)..(1853): n is a, c, g, or t
  misc_feature (1859)..(1859): n is a, c, g, or t
  misc_feature (1864)..(1864): n is a, c, g, or t
  misc_feature (1868)..(1868): n is a, c, g, or t
  misc_feature (1894)..(1894): n is a, c, g, or t
  misc_feature (1936)..(1936): n is a, c, g, or t
  misc_feature (1947)..(1947): n is a, c, g, or t
  misc_feature (1972)..(1972): n is a, c, g, or t
aggtcataggtcatttttgcagcttattgtgatgacaacagtggaggatggtcttccacttcaccttaaaagcggctgttctctgattatcattaagcatggccacgcccgcacttaacttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtantcccagcactttgggaggctgangcaggcggatcacagggtcnggagttcgagaccagcctggccaacactggtctctgtgaaactccgtctctactnaaaatncaaanattngctggacgtgttggcgggcatctgtnataccagctacttgggaggctgaggcagaagaatcgcttgancccgggaggcngaggttgcagtgagctgagatcgcnccagtacactccagcctgggtaacagagctagactccatctc

SEQ ID NO: 403583 - DNA, 1297 bp, Homo sapiens
  misc_feature (1038)..(1038): n is a, c, g, or t
  misc_feature (1061)..(1061): n is a, c, g, or t
  misc_feature (1081)..(1081): n is a, c, g, or t
  misc_feature (1136)..(1136): n is a, c, g, or t
  misc_feature (1142)..(1142): n is a, c, g, or t
  misc_feature (1147)..(1147): n is a, c, g, or t
  misc_feature (1151)..(1151): n is a, c, g, or t
  misc_feature (1177)..(1177): n is a, c, g, or t
  misc_feature (1219)..(1219): n is a, c, g, or t
  misc_feature (1230)..(1230): n is a, c, g, or t
  misc_feature (1255)..(1255): n is a, c, g, or t
cacagtatgaccttacttgaaagttaaaaggctggatcgcataagctttcattgagcccttttttaacagtgagtttattttgaatttgtttttatgtaggtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtantcccagcactttgggaggctgangcaggcggatcacagggtcnggagttcgagaccagcctggccaacactggtctctgtgaaactccgtctctactnaaaatncaaanattngctggacgtgttggcgggcatctgtnataccagctacttgggaggctgaggcagaagaatcgcttgancccgggaggcngaggttgcagtgagctgagatcgcnccagtacactccagcctgggtaacagagctagactccatctc

SEQ ID NO: 403584 - DNA, 1338 bp, Homo sapiens
  misc_feature (1079)..(1079): n is a, c, g, or t
  misc_feature (1102)..(1102): n is a, c, g, or t
  misc_feature (1122)..(1122): n is a, c, g, or t
  misc_feature (1177)..(1177): n is a, c, g, or t
  misc_feature (1183)..(1183): n is a, c, g, or t
  misc_feature (1188)..(1188): n is a, c, g, or t
  misc_feature (1192)..(1192): n is a, c, g, or t
  misc_feature (1218)..(1218): n is a, c, g, or t
  misc_feature (1260)..(1260): n is a, c, g, or t
  misc_feature (1271)..(1271): n is a, c, g, or t
  misc_feature (1296)..(1296): n is a, c, g, or t
gatggtctcgatctcctgacctcgtgatccgcccgcctcggcctcccaaagtgctgggattacaggcgtgagccaccgcgcccggccgtatatgctttttagaagaaccaaattcaagaacttaacagttggatcttctaagtttgcctcagtgaaatgagggcacatattcggacttgtcagaagtacatagataagtatggaccactacaagaacttgaggagacagcagcaaggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtantcccagcactttgggaggctgangcaggcggatcacagggtcnggagttcgagaccagcctggccaacactggtctctgtgaaactccgtctctactnaaaatncaaanattngctggacgtgttggcgggcatctgtnataccagctacttgggaggctgaggcagaagaatcgcttgancccgggaggcngaggttgcagtgagctgagatcgcnccagtacactccagcctgggtaacagagctagactccatctc

SEQ ID NO: 403585 - DNA, 1155 bp, Homo sapiens
aggtcataggtcatttttgcagcttattgtgatgacaacagtggaggatggtcttccacttcaccttaaaagcggctgttctctgattatcattaagcatggccacgcccgcacttaacttctgacagtggggaaagcagctgtgtgtgatagcttggaaggtttactgctgcctcaagtcctcttctctgcagttgaggtttcaggtttcaatcctcccaataccacaagacagagcacggggcggctgccgcctccgcctccgcgccttaacctaggcggcttgccgaagatctcagccccgcggccgcgcgctcgccctgccctagaccagggttgggcgcagcggcggaggtggcttctgggctgcgcgagctgggagagctgggaggcggcgatcgcagctgggccgggacttccttcctccaccgcacggcaacaaaacaaccctgcggcaggcactgagtgcttcgcagctgtctgggcgagaggcacagcgatgggctccgtgctgagcaccgacagcggcaaatcggcgcccgcctctgccaccgcgcgggccctggagcgcaggagggacccggagttgcccgtcacgtccttcgactgcgccgtgtgccttgaggtgttacaccagcctgtccggacccgctgtggccacgtattctgccgttcctgtattgctaccagtctaaagaacaacaagtggacctgtccttattgccgggcatatcttccttcagaaggagttccagcaactgatgtagccaaaagaatgaaatcagagtataagaactgcgctgagtgtgacaccctggtgtgtatgtcccttttgtcagagggaactgtatgaagacagcttgctggatcattgtattactcatcacagatcggaacggaggcctgtgttctgtccactttgccgtttaatacccgatgagaatccaagcagcttcagtggcagtttaataagacatctgcaagttagtcacactttgttttatgatgatttcatagtaagtatattttcttatttttacattatgttttcatgctgtcttgttaagcttacctttccgatccaagtgaataaaattatagaggaaaaaatgtgtatatagctatagtgttgagtattagcattaagtaagaaat

SEQ ID NO: 403586 - DNA, 1506 bp, Homo sapiens
gatcaagttcatggaagtatatgctttttaaaaatcaaagggagactttgtgaccaacagggtcactgctgtagcaaaatataaaatatgccatggttaaagcagtaatgattttcttttgggtggggttcctagagattccaagaagacatcatgaaatatgtgagtgaaacatatcaccagtgaagttctgtctgcccggcactaactttttacttggcttgagttgtaggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaaggtaaggagaatgacatcatgagaacatggaccaagaggattcctaagtcatggcctttctgctctaccacatacagaatcaagagggtagatctcctcaggccttgacttacttccttctctacatatttaagactcattgtctaaatgatttaatagaattgtgagattccgtatatcttcaataaagagtgctgaatttcattctaattaatgccaatgtttctaggacaggtatctagtactctaagatgattttcactttttcttctcttttattataaaatccataatatattcttaagaaaaagataaatgaaatccctaaatatattgaactggtaatactaatgaggaagagggtactgcattagattggcagtactatatttgctgtgagttatagtaccagatcgaagctcaatttacttgtacattttcgcaaccctactattagccaccacttatttgacattctcattcccatattagtttccaactttaccaactacacttttgcctgggtatttacagtgtttaaagagagctgaagctggaaaatcacacttctttagttgttattgacatcgagcaaagaattttacttatgttccaagtttcatgacagggcagagtaatttttcccatgctttatacatgctgtttgacattcataatttggagatgacttagaataaaacatgaatatactcagctaattagagcaaaattaattgagccagtgcaagtgaatttgtcatggggcaaaataattcccacaaatgtaacagtgattcagattaatgaaaggacaatttcaattctctcataatcagtaggtataagtacttcatccagggagagggaaagttgcaaatttaaactgagatagtgatgtggcatctgtcctcttgtaagtaggagcagcccactagctgttatggcttatctggttgcctgttatgacttacctggttgcctatggctgtaaaaggtattttgatataagaaattgacaattattgaagttctgaactctgaaaagttggaaggattttaaaagttcttaaaaaaaaa

SEQ ID NO: 403587 - DNA, 717 bp, Homo sapiens
cataagagttccatgttgcaatcagtcttttaaaagccaaaattaccttttgcctttggcactgctatctgataccttaaatggagtattttgctaccaaatgaaactaaataggacaagaaagagctgctcatctctttattgcaccatcattgatactaaacttttccacaaaagggtaatgtttctctttaacctcaggggcacatgtgagtcattgctctttcagatcctaactatccagtgatatctattaagtcaccacttgtacctttaacacagtttctattcagtcctcctggcctcccgcaaggactgcattagtctagtcaaccagtagtgctgctgccgaagttacctattcttcatgcttgactctaagaacctcttcctttctttcttcttgttttctaggcatagggatttccagctttacaacatgctatgaattatcctcctctgtgttaacacttgtgttaacctcatccgaagtcctgggggatgtcctgttcaacctgccatttcacccatagtagagttggtccacagtgaaaagtggtgaaaagactgaagtctttataccacttgcatatattgttcctgatcctgcgtgtacatttcagagaactggtgaataaactctccgctccatgcctttctgctcagagaggttacatcttatattctccaaatttaaattaaaatgtagcttccttc

SEQ ID NO: 403588 - DNA, 442 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaaggcatagggatttccagctttacaacatgctatgaattatcctcctctgtgttaacacttgtgttaacctcatccgaagtcctgggggatgtcctgttcaacctgccatttcacccatagtagagttggtccacagtgaaaagtggtgaaaagactgaagtctttataccacttgcatatattgttcctgatcctgcgtgtacatttcagagaactggtgaataaactctccgctccatgcctttctgctcagagaggttacatcttatattctccaaatttaaattaaaatgtagcttccttc

SEQ ID NO: 403589 - DNA, 207 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaaggtaaatcgccggaattaggaatgtctgtgtataaatatgtatgtgtgtgcatgtgtgagtgtgtaata

SEQ ID NO: 403590 - DNA, 14206 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403591 - DNA, 14077 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagaaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403592 - DNA, 14107 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403593 - DNA, 14200 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggagctaacagaggaattaggggagctggaggccagctcagatgaggaggcgatggtaactaccagggttgtccgccggcgagtgattattcagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403594 - DNA, 4889 bp, Homo sapiens
ttcattcttttaaatttttttaaccaatatttcttttgaataggaagctctcacatggcaatctataggtggatgcagaagttgtcagtgtctatataacaggttgggaagggtgatgagtggtgactgctgagacctggaggggaagtaggaatatatttaaaatcctaaatcttgacatcacaaaacaaaaaagtcctatacttctttttccccaccacagttgttaaattttatatttgcttaatgaattattcttgtaaatagagatcagccatctagagaaaagctcatagcattaggtttgacattgtaaatttttattaaatgaataaaataaaatattatttgtatatttaaatatacatgttattccaagaattaaaatatagaaatgggtatatcaacccaaatgagcataatttcattgtattttgatggtgcagaatgtattttggggtttgtattgctgattagtagtgagtcagtggaggcagtatgccaataagaacgacaaagaaatatgtactgctgcgggcaagccacctgagtgttaaagaaagatgactgagctttggctgatttcagtgagctttcagtgtgctctaagagaaagcattaacttcattattacattttatttctaagtcaagacatatcagacacagctattaatgctgtgatagtccagtacaattttctaatttgtaactcaaaaagaaaaaaatcccagacattgtacattgaaaatataccttagtatttagtagctcttggctgggcaccatggcccacacctgtaatcccagcactttgggagaccaaggcaggaggattgcttgagtctagtagttcaagaccagcctgagcaacatagcaagaccttgtctctattaaaaaaaaaaaaaaagaaagaatttagtagctctttgttagaataatgcttctaaatattgcctgtgtattgaaaattttccaccatatgcttatttgtagcttttagtattttcaaccaatatctgtaatgattgggatattatcatcactatttctaaagacaaatgccatccagttcatttaaggtcaaactttgagactgccgtggtgacctagtatctggaattagtatatttataatgttggttcttttgtctcttgaatctataaactttgtacttaagccaatcttcttttctgcctgtcttctataaactgttagtaataaaaaaagagtatgttgactgtatgcttgcctgttgatgcttgttgaaagggtatttatttactctttccttttcttctaaatactctctactcttccttctctcttttttccatcttgcatggcatcttggggcggaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403595 - DNA, 7130 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaaaaaacactacatatcaaaacaaagaacgcagtgaaattacacagaggtatctcaagattgttcagatgttacagatcaatg

SEQ ID NO: 403596 - DNA, 778 bp, Homo sapiens
ctccttttagacaagagagccaatccgaacgccagagccctggtaaacttggcccagtccacattaactgaatacagattgagacaaacaaacccacattcattgaccaacatgcatacaccagcaatgcaaggttacagatatgtagttaatcctgctaaatttgtcatccttcacaatcagcctgtgtacttcatacattcatagtttgttagcaaatgctggtgagcaaagatgtatttaagagaacaccaatgtaacatttctgaaactagtgagttgcaaacagatagatatgaaacctttggagtgataagcagttttaaatggaaaatagaagttgaaaaataggaaattacaaaataaattctagatacctctagataaagttagaacacgagtatgaaaagttgaatttattaatctctttttggaaaaaaaattaatggtgaatatatttgactatgtaagggggtataaaatgtaagtctatgcagagttcaattgaaaattttcattgttgacttgattactcaaccataggctaatagaaaagttatgcctagtgtgttacggcttcagggagcattttatatacaccatttcaggaactgctcaagagaaaactgcaagaggctgtccctagagcagctttatgtctccccagttctgatattgaataagtcttccttgcttcacttattttctaacaataatcattggaagtattagacatgtactaatttatgcctcttgtgtcctaattcccaaactaaaa

SEQ ID NO: 403597 - DNA, 344 bp, Homo sapiens
gcccagaaggaggtgtactgagcagcacagtggtgccccaggtgcaggccgtcttcccagagggggcactcaccaagcggatccgcgtaggcctgcaggtatgcccatgttagatgcaaatgatcctaacaggattgtattctaatgattaaaaattagctttgtcaaggactgttacctttgttttataatcacaccaaaaaggaaggtagcattaatggtaaagctaaagtcaaaatccatatttattggttactaatctatttaaaaattcaacttatatttggacaattaaccaaaattaatctccagctacaaatgttttcttcttgtaaaaaaaaaaa

SEQ ID NO: 403598 - DNA, 332 bp, Homo sapiens
gagccctcagagcacagagaggagagctctccgcggaaaaccagcctcgtaatagtggagtctgccgataaccagcctgagacctgtgaaagactcgatgaagatgcagcttttgaaaaggtaagacattcctctccactttctcgcccacctgtaacaaagctacaaatcttccagtttccatttctatgatggtttattttttgcacttcaaaacaaaaaagttaaccaaattaattaacctggcacatggaaaccctcaatcccttttaaaatctgagagccgatgaatcttgaagaaatggcgcacagttccagtgctgttgatttga

SEQ ID NO: 403599 - DNA, 7897 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttggtaaacttcacctgccaacggctcctcccccacttaatgagggagaaagtttggtcagccgcattcttcagctggggcctcctggaaccaaattccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403600 - DNA, 14290 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403601 - DNA, 11144 bp, Homo sapiens
ttcattcttttaaatttttttaaccaatatttcttttgaataggaagctctcacatggcaatctataggtggatgcagaagttgtcagtgtctatataacaggttgggaagggtgatgagtggtgactgctgagacctggaggggaagtaggaatatatttaaaatcctaaatcttgacatcacaaaacaaaaaagtcctatacttctttttccccaccacagttgttaaattttatatttgcttaatgaattattcttgtaaatagagatcagccatctagagaaaagctcatagcattaggtttgacattgtaaatttttattaaatgaataaaataaaatattatttgtatatttaaatatacatgttattccaagaattaaaatatagaaatgggtatatcaacccaaatgagcataatttcattgtattttgatggtgcagaatgtattttggggtttgtattgctgattagtagtgagtcagtggaggcagtatgccaataagaacgacaaagaaatatgtactgctgcgggcaagccacctgagtgttaaagaaagatgactgagctttggctgatttcagtgagctttcagtgtgctctaagagaaagcattaacttcattattacattttatttctaagtcaagacatatcagacacagctattaatgctgtgatagtccagtacaattttctaatttgtaactcaaaaagaaaaaaatcccagacattgtacattgaaaatataccttagtatttagtagctcttggctgggcaccatggcccacacctgtaatcccagcactttgggagaccaaggcaggaggattgcttgagtctagtagttcaagaccagcctgagcaacatagcaagaccttgtctctattaaaaaaaaaaaaaaagaaagaatttagtagctctttgttagaataatgcttctaaatattgcctgtgtattgaaaattttccaccatatgcttatttgtagcttttagtattttcaaccaatatctgtaatgattgggatattatcatcactatttctaaagacaaatgccatccagttcatttaaggtcaaactttgagactgccgtggtgacctagtatctggaattagtatatttataatgttggttcttttgtctcttgaatctataaactttgtacttaagccaatcttcttttctgcctgtcttctataaactgttagtaataaaaaaagagtatgttgactgtatgcttgcctgttgatgcttgttgaaagggtatttatttactctttccttttcttctaaatactctctactcttccttctctcttttttccatcttgcatggcatcttggggcggaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggctcaggaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctcgtcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaactggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatagcgtgagtgaggaagtagaggaaatacctgcttcggatgctcaacttaactcccaaatggggatttcagcctccactgaaacacctacaaaagaggctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaagatccacaggatgagcaggaacggatcgaggaaaggctggcttatattgctgatcaccttggcttcagctggacagaattagcaagagaactggatttcactgaggagcaaattcatcaaattcgaattgaaaatcccaactctcttcaagaccagagtcatgcactgttgaagtactggctagagagggatgggaaacatgctacagataccaacctcgttgaatgtctcaccaagatcaaccgaatggatattgttcatctcatggagaccaacacagaacctctccaggagcgcatcagtcatagttatgcagaaattgaacagaccattacactggatcatagtgaagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatattttgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaagggagacgatatgcctgaaatacccccagaaacagtcacagaagaagaatacattgatgagcatggacacaccgtggtaaagaaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggacaacaatgagtaaagccatcacacagaagagggctgtggtgaaggaccagcatggaaaacgcattgacttggagcacctggaggatgtaccagaagcactagaccaggacgacctccagcgcgatctccagcagctccttcggcatttctgcaaggaggacttgaagcaagaggccaagtgaggggctgcccagttctcacaccagaaaccacacattcactcaatatgcagcttcctgtttcagtaggggagtgacctaactggcctaattaatgggataccccgacatttccactgttagcaaatatacggcattttgctttagttttcccccatcctctttaactataaagctaatttgtgaccaaagatggcatccttcatactggatgctgtatccaatactttgttgtgtctgtgctaacctgggaactggccacctccattgttctttgcttctgcacaagatccatgaaaatccattgatcagaagaacttcacctgcagacctcttcaagtgacactatgtaggaatccttccaaggaatatctatgtacaatgtatatagctgaaatgctcagatgaacaacatattaaaattaaaaccactgcctattgtaactacactgggcatcagaataaaaggcctctagaaattgctgaacaatggttaattaagatattgctaacacaatcgagtgataatacagttttactgcaaaagaagcacttcaaacctattatgtccttagaacttccagagtagccactgctcccagttaaaggtgggtcagtagccttgcagaactgtcctgagaagttattgctggtgctggccagccatggcttaggactccaacagccactctgagggaggggagaagggagcagaggccacgcagaatgaaccgatggggtattcagttgctggcagctacattgtgtggcattctagcatcttcaggtctttagatcttggacaagttggcagggtattttaaaagctataactactgtagttttccagttttcattgctgctttagcaaaccacgctgtcttacagtggtactttcttctggccactgcactgtagataattcattggaaacaagatttacccactacataaaaggttaaactccttcagtatgttggagtggtttctttttttttttctttctttcttttttttcttcaggtttatatcttctctaatacctgcatgtggcgtttaaaaatcaagaccacggtcaaacccctcttctaatcacattaattgtttccattctttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtgaaaaaaaaaaat

SEQ ID NO: 403602 - DNA, 5649 bp, Homo sapiens
ctgtacaggcggcacggtttgatggcagagatattttctttccaaactgttcaaaatgatgaacgaagatgcagctcagaaaagcgacagtggagagaagttcaacggcagtagtcagaggagaaaaagacccaagaagtctgacagcaatgcaagcttcctccgtgctgccagagcaggcaacctggacaaagttgtggaatatctgaaggggggcatagacatcaatacctgcaatcagaatggactcaacgctctccatctggctgccaaggaaggccacgtggggctggtgcaggagctgctgggaagagggtcctctgtggattctgccactaagaagggaaataccgctcttcacattgcatctttggctggacaagcagaagttgtcaaagttcttgttaaggaaggagccaatattaatgcacagtctcagaatggctttactcctttatacatggctgcccaagagaatcacattgatgttgtaaaatatttgctggaaaatggagctaatcagagcactgctacagaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaagatgatggtgaataggacaactgagagtggttttacccctttgcacatagctgcacattacggaaatgtcaacgtggcaactcttcttctaaaccggggagctgctgtggacttcacagccaggaatggaatcactcctctgcatgtggcttccaaaagaggaaatacaaacatggtgaagctcttactggatcgaggcggtcagatcgatgccaaaactagggatgggttgacaccacttcactgtgctgcacgaagtgggcatgaccaagtggtggaacttctgttggaacggggtgcccccttgctggcaaggactaagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctgaatggttttactccactgcacattgcctgcaagaaaaaccgcatcaaagtcatggaactgctggtgaaatatggggcttcaatccaagctataacagagtctggcctcacaccaatacatgtggctgccttcatgggccacttgaacattgtcctccttctgctgcagaacggagcctctccagatgtcactaacattcgtggtgagacggcactacacatggcagcccgagccgggcaggtggaagtggtccgatgcctcctgagaaatggtgcccttgttgatgccagagccagggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaagaagggttttactcccctgcatgtagcagccaagtatggaagcctggatgtggcaaaacttctcttgcaacgccgtgctgccgcagattctgcagggaagaacggccttaccccgctccatgttgctgctcattatgacaaccagaaggtggcgctgctgttactggagaagggtgcttcccctcatgccactgccaagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaagagtggactcacatccttacaccttgcagcccaggaagataaagtgaatgttgctgatattctcaccaagcatggagctgatcaggatgctcatacaaagcttggttacacacctttaattgtggcctgtcactatggaaatgtgaaaatggtcaactttcttctgaagcagggagcaaatgttaacgcaaaaaccaagaacggctacacgcctttgcaccaggccgctcagcagggtcacacgcacatcatcaacgtcctgctccagcatggggccaagcccaacgccaccactgcgaatggcaacactgccttggcgattgctaagcgtctgggctacatctccgtggtcgacaccctgaaggttgtgactgaggaggtcaccaccaccaccacaactattacagaaaaacacaaactaaatgtacctgagacgatgactgaggttcttgatgtttctgatgaagagggtgatgacacaatgactggtgatgggggagaataccttaggcctgaggacctaaaagaactgggtgatgactcactacccagcagtcagttcctggatggtatgaattacctgcgatacagcttggagggaggacgatctgacagccttcgatccttcagttccgacaggtctcacactctgagccatgcctcctacctgagggacagtgccgtgatggatgactcagttgtgattcccagtcaccaggtgtcaactctagccaaggaggcagaaaggaattcttatcgcctaagctggggcactgagaacttagacaacgtggctctttcttctagtcctattcattcaggtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgcgtaggcctgcaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtggaaccacccctgcccagtgggaagatattacaggaactacgccattaacatttgtcaatgaatgtgtttcctttacaacaaacgtgtctgccaggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtgttagaaggaaaacccatctacgttgattgtttcggcaacttggtaccattaactaaaagtggccagcatcatatattcagtttttttgccttcaaagaaaatagacttcctctatttgtcaaggtacgcgatacgactcaggaaccttgcggacgactatcatttatgaaggagccaaaatccacgagaggcctggtgcatcaagctatttgcaacttaaacatcactttgccgatttatacaaaggaatcagagtcagatcaagaacaggaggaagagatcgatatgacatcagaaaaaaatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacatacccccagatgagacacagagtacacagaaacagcacaaaccaagcttgggaataaagaagccagtaagaaggaaattaaaagaaaagcagaaac

SEQ ID NO: 403603 - DNA, 265 bp, Homo sapiens
gatgtcctgagacccacccccaccaagagtatgcctgcagaaaaacaggtagtctgacttggctaaggtccgagctacttgccttgctggtttggattgagtatacacactgggtgagtctaacggtggacgtggaggagtaggagaaccagagccagttcaggtgcagggaggctgggagaaggcaggcttggaagaaagaatgaggaagggaaaagaaagggcaagagagacagagagagcaggtgctgtggggagaggaact

SEQ ID NO: 403604 - DNA, 163 bp, Homo sapiens
tggctctgtgacccggggagtctacctgtctgagcctcgactttctcattggtgaaacggtgatgataacagctcatatctcagaactgggtgtgaggatcaaattaggaaaatccgttaataatggcaaatacttatttggcacttactgcatatcaggccc

SEQ ID NO: 403605 - DNA, 213 bp, Homo sapiens
ctctataggtatcttttatacacatatactgagtgacgtgattacaacagtcaagcaaattaacactatataagacttcctggtttaagaagttgcaaatatcttctcccaacatacaggctattaactttgtctatgtgaggtctaacaatgaatcaaaattcttagctttgatgtgataaaatctaccaggcttttatttttttttgtaat

SEQ ID NO: 403606 - DNA, 176 bp, Homo sapiens
cgggagaagctgaccctcaccacatctatcttttacaaccttttacgctggcaactgtgtcctaccagagagaacccaagaggcctatgtggccaaaccactttaggttggtccacaacaaacatgccacttggtgaatctgaaatgggtagacttcaggaagggatcccttagta

SEQ ID NO: 403607 - DNA, 520 bp, Homo sapiens
acctgtaaatgttaccttataagggaaaagtgcctttgcatacgtgattaagtagcttgaaatggagagattatcgtgaattatctaggtgggtcctaaatgcaaacgcaaaggtcctaagagagagagagaagcagatttgatataggccgaagagaaggcaatgtgaccacagaggcagatattggagtgatgtggccacaagtcaccaaatgcctggcaaccagcagagctagaagaggcaaggaactgattctcttgcagagcctccagagggagggagggagccctgccaacaccatgctttcttccccatgagactgattttggattcctggcctccagaattatgaaagaataagttgctattgttttaagctaccgagttttgataatttgttatggaaactgtagggaactaatacatatgagcgtgctcataaatcacatacatgctgtactgatgaatagtttacaggtcttcagctggggcaatagtggggtacagtagtggagatca

SEQ ID NO: 403608 - DNA, 396 bp, Homo sapiens
gagaaaaagcatcccacctggggaggaaaggaagggctgggaaagaccccagaacggcacccctccaacaaggcaggaagggagaaggacagcccctccggctgggtggaggatgccaggaaggggctgaaccacggcctgctgggaatcacggcccttcctttcctcagatcgccttgcggcctggcactggagctggtgctgacagggacgctggccaacagggtggtatttttcacccgggtgatctgagctgctggcaggtagggggtgggctgggggaggcgggtgagggctggtcttagataggaatgcagcccagaagggaccaagcacttgcccatcctcactggctttcaaaaaataaacagtaaaaataaaagtcccatgaacctt

SEQ ID NO: 403609 - DNA, 235 bp, Homo sapiens
cagtgatcataaataaaatcttgtcgtactattataggatgtttggcaaggacaagaattaaggcacctttacaactccctaaggaatctggtgatatttctaacatgatctcacacattctgtcctgcccgaccttccttgtatcaccttcctgagttatagcttgtatccgttaccctctcctccttccacagcctctccccaaaataaagaattgctgacctgaagaaaaca

SEQ ID NO: 403610 - DNA, 212 bp, Homo sapiens
tacctacaaagcatttcacctatagctataatattaccattaaaagcatatttatgtttaagcaacttttatttagcttaattatgaatattccattgaactgccatcatttaatgtagtgtctgttataagagttggaaatgttgcaagaagtatgtgtaacctcaataacattctaagacaaatgcaatcactgttaacattttaggagt

SEQ ID NO: 403611 - DNA, 496 bp, Homo sapiens
aagaattgtcaagggtgcctccgggcttcatgatgtttacggtcatatttctaaatctatactccgcctatagaaggatcttaacatggctacaagtcccaacattgggtgcctgaagttaatttattatcttagtcaagatttacatgtcacttttgagacctgaatctactccaagaatttctgttactgagtcatcatgataatactgtctgatagatagaaagctgtcttgtatgcagttgctattcagttaatgttgaataaattattttagaactatggatatttcacttgacccttccatcctctttttatatgtagagtgaaataagaaatttctgtagttatacaagtaaatgtagttcttaggccaggtacagtagctcatgcctataatcccagcactttaggaggctgatacaggaggattgcttggagccaggaattcaagaccaccctgagcgacatagtgagacccccatctctaccaaaa

SEQ ID NO: 403612 - DNA, 186 bp, Homo sapiens
aatcctcctaactggttataaacacatctcaaactaattcctctctagaaccctctgctctctgaaaggtgaaacaaatggcaagacaaggatgcattaggggctgcatggtggctcacaccaggaatctgtatttttaagaagtgccactagataatgctgaagtattaggaactattggtttat

SEQ ID NO: 403613 - DNA, 858 bp, Homo sapiens
aaaaaaatcagagaagggggaaaataaggaagcagcagctaaatatctgaatgtgcccccaaagatattcctggaataaccagctttatagcatagattcaaaaaaagttagtgccagcatgaagcagcatcatgcacccaggagtcagtgtgctggcagcaccattcctctatatatatcccaggcaccgaacctcttggtctcactatcccaaaagtaggaagaacagacgggccactagctgaagagaactgcttaattagtgccagcaatgtgccaggcactaacatattttgcatttaaccctcactatcacccaaggggtgggtgttatttcctcacctgataagttaagtaatcttcctgtgtttacatagataagtggcagagctgggatttgaactccttcccctgattcctacctaaatttgaacagtggttctgtacattttccatttgtagatcctctttgaatcttcctgcccacataactaaaagaattttcttccctaatttttttgtttacttttttggaagactcactattgttaaaatgtcagtgaaatcagttgctttgatttatacagtcaaagaaatcccaatcaagatcccagcagcctgttttgtagaaattgataagctggttgtaaaatttatttaaaaagcaaaggctctagactaaccagaaaaaattgaaaaagaaggacaaagttggagaatttaccctacctgatttcaaaactttacaaagctagagtaaaatttacaaagctagagtaaactttacaaagctagagtaaactttacaaagctagagtaaactttacaaagctagagtaaactttacaaagctagag

SEQ ID NO: 403614 - DNA, 118 bp, Homo sapiens
ctgttccattcgccactcacaagatctcctacctccaccccctaccctggcacaaaggccacttctgatggctcagaacacatctggcagagtgacaaagtgaaaggcctttaaaaag

SEQ ID NO: 403615 - DNA, 382 bp, Homo sapiens
gtagagatgaggtttcgccaagttggccacgctggtcttgaactcctgacctcaagtgatccgcctacccaaagtgctgggattacaggcgtgagtgactgcgcctgctgccccccacatttcttaattctcccctagaagacaaagttgggaaagtatctgatttctgtgtaattgctgcttttagaatcatgaacctaaacgttttccagaaacgactctcccagatctcatgcacttatttcatttgtagaatccctaaaacacagcaaaggggatatcagaaggccataagcagtaaagggcacaggaatggggcaagcctagggcacactggagccaactgttttggtagactatacagaaaacgtagcacacttac

SEQ ID NO: 403616 - DNA, 157 bp, Homo sapiens
catcttacagatgaagaaatagtacctagttaatgacagaactaggattcaaacccaggtacttgggctcctcagcatggcttgagagacagacagaaagagagagagagagaaagaaagaaagagaaagaaagaaagaaagagaaagaaagaaatg

SEQ ID NO: 403617 - DNA, 528 bp, Homo sapiens
ttcattctgacaagttgcactaaactgaggcctgaagcatactgtgagaacctctctgtggatcccataaagtactcaggaaatatgcacttgacatctggtttgctggattcctgctgagaaatggaggatttggtgtgaggctgtcggtccggactggcagattggctgtgcatataactgtgcatgaatccacacaaaggggtcatgttcaggcaatacttgggcatgttccaacagaatctcaagaaggcatatgagcagagattgaacagttggattcttgtacagaaaaggcagtggtaacttatggatgggagtgttaggcatgcacctctaagaaatagggaatgtgaggtgcgtgctgcagaatatgattcaaataccaagatactttaaagtacatatacttggaggaaagggggaaaaataataagaccttggtaattgttagcagaattgtaaaactgcacttctcagtgctttttgggtagatcacaataaaatacttttaaatattttaaattt

SEQ ID NO: 403618 - DNA, 365 bp, Homo sapiens
aatgtgcaaagtacctagcacatagataatacccaattaatgctagctatttttattattaaggttaaacagagacccaagggctggaatcattctacactggtgtaattattaatacatcaaacctattctagttttccatgatatatatgagtccatgataaccttttaactagtaccatcacaggcagttaaaacgatctatcagaaggtacataaatccaaaaacagcagtgtagtgattacattgtacagatgaagcagcagtcttaaggcagaaagaaacatgttcatggaatatagaaatagaaaatctgtatcaatttctttttttcaaattcagtgagtaaaaaatgtaccctttt

SEQ ID NO: 403619 - DNA, 334 bp, Homo sapiens
ctacgcaatagattacaactgtaatttccagtttcagaggagctataagacatctttaaaaagtgatgtaagaaatcagaatttgaaaatctcaaattaggtgacaggcttcaggaagaattaataaataaaagctcatttcagaattgaagactgaacctgaaggaagacaagaacaaatagatgcaaagataatgttggtaagaggaatagaaggggagcaggaggaaaattgtaaaaatcacaaagcaataagaacaaaaagattaaggttaagtgataaatactgaagacaggcaaagataattcagtctaccaataaagagtccctgag

SEQ ID NO: 403620 - DNA, 1011 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccaggtgagatcccggggaggcccggcacggccgagggggcagaggctgacgtgcctgccagcctggcccggagagggtcggaggctcgaggaggtgtctggcccgtcccccgcccagcgtgctcttgaggctgagtcgcgccaagcccctcgcccatcactaccctgaactggggtttccagcctccctatgcaaagggactcggaattcctgggcaccactcccaccctgccctccttggggtcagagtgttcctgggtgagaagagtttaagaatgggaaggaagaaagggaggga

SEQ ID NO: 403621 - DNA, 2417 bp, Homo sapiens
tttattcatgccgggctgatctttgttgttacttgctgtgcccgcggccgacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403622 - DNA, 3002 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcaggaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403623 - DNA, 4012 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttgaaaaacaaaaacaaaaaaaaaaaaaaaaaaaaaaaaaaaaaaaacaacaaaaaaaaaaaagggggggcccccacaaaatcccccgcggagggcccacagacagtcacaggtcacaccacgaatatcagtagacaccaagagggccccccaaaaagggagcgcacacacaaaacacagccgagaaccacgcgcgcccctcataaaaaaagagggcgcggggagagggagaaacaaacgtgtcgaaggggggaaacacccgcgagagcaacaacgcccactaaacccactgggcggcgaggagaaacacactgcgggccgcgacaaccccctctcccgacgggagacgaattaccaacgaccacgagagaggccgacacaactaagcaccacatccgccacacacacaccaaaacaggggtgctaacaacacaacgcgaagaaaaactacctcgactgcccgccgacaaaagcaatacggcacacaccggcggacgcacggcagctcagttccaagacagaacataattagctaccagggagagcgccggcacagaataaacaccaagcaacagacaaccaagagagagacacaggcgacaaacacgagccgacgacagcagagaacacacgccagcgcacgcagagacgcaggtgcgcagccggggaggagtggcggagtcgccgcccaggatagggggggaggacggggagctacgacgcgagagtgagcaggaggcacgaagaagcacgacagtctcgaggagagagcgagcaggacgcacgaagtcggtcggactgtgcaccggtagagggcggacgcagccacgggcggcgcgctcggaccgcgacgcaacagggcgggggcggatcgacacgacgcgtccg

SEQ ID NO: 403624 - DNA, 1700 bp, Homo sapiens
  misc_feature (50)..(50): n is a, c, g, or t
ttggctaggtggaggctggggtcagtcggccgaggggaggacactcccgngggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403625 - DNA, 2555 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403626 - DNA, 2506 bp, Homo sapiens
  misc_feature (2414)..(2414): n is a, c, g, or t
  misc_feature (2416)..(2416): n is a, c, g, or t
  misc_feature (2420)..(2420): n is a, c, g, or t
  misc_feature (2423)..(2423): n is a, c, g, or t
  misc_feature (2432)..(2432): n is a, c, g, or t
  misc_feature (2435)..(2435): n is a, c, g, or t
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgagattcaaggctgctggaggntncganatntgcccccgnggnctccctgaagcagtgggttccccgaccctggttcctgctcgactttggccctaacgaacgttgcggtacac

SEQ ID NO: 403627 - DNA, 2943 bp, Homo sapiens
  misc_feature (2554)..(2554): n is a, c, g, or t
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgcacgtggaaggcagcagctaacactccacgagcacactacagccgggcccctgccacaggcggaaggaactcgatcggcagcaacgacccatgccccgggaccgcatgatacctcggtcacccaactagccatgctcagcaacaaaactgctgtgcatgagacatgggatggacacgcaagatcgacagacaaccacaacgcgccccagctgcgcccagagccgcgccgcacccaagaaggcactacaaaagcgcctcggcataggaagcagacctaccgacaacaatgctggcgcacaaacacagcgcgagacagatcaccacgacacagnacacgcaccagtcggcaggtcaccgcagagcacccacgatgcgcctagacccccatagcctgccagggaccgtactcaggtgggcacaccccacatggaaccacgcagcaacgcaatggtcaccccacgcgatactaagccatacacaaaagtggcacccacgggccagcgccgcactgacaccttcatgctggcggaccgcagtacaccagggcccacgacgcgacgcccagccagatctcaactcacagaggccactcacccacccgaatcacaatcccacactcacacacaccatcacacaggaaaggcacttcacacccaacacgagcctgcacacactgacacgaggcacaatcacacggaaccacacccgacaccgcacggcg

SEQ ID NO: 403628 - DNA, 2824 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggtaagggcctgggcgaggagggcagaggccttcccagaggaggaggtgcaggatctggtaaacaaacaatggaatcaggaaaatgggagcaaagaggggttcccaggggggaggcagaccctggggtcacaactgcattcattcatgtattcaagaaatatttactgctgggcacagtggctcatgcctgtaatcctagcactttgggaggctgaggcgggaggattgctcgagcagggggagtttgaggccagcctggg

SEQ ID NO: 403629 - DNA, 2317 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccacacacccactcgcttccgctgcaccagctccacgtagtcctcggagcgggcgtagtactcatcggggctcaggacgccccagaagttggaccacagcttgccgtggcgggacagcatgggggcgatcaccttcctgttctcctcaatgagga

SEQ ID NO: 403630 - DNA, 223 bp, Homo sapiens
ctcgggaggctgaggcatgagaattgcttgaaaccgggaggcagaggttgcagtgagccaagatcgagccaagatcgcaccactgcactccagcctgagtgacagagcgagactatctcaaaagaataataataatacaaaataaaagaccccctgcgcccgcagctgtccctgcagcctcttccctcctctcccccaggcgcgggcggtgatgaactttgtg

SEQ ID NO: 403631 - DNA, 565 bp, Homo sapiens
agtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtgtattgggtatactggtgttatgcttgaaatcacatcttaaaagaagaatggggctgggctcagtggctcatgcctgtaatcccagcactttgggaggccaaggtgggtggatcggttgaggccagaagtccaagaccagcctgggcaacatagcgagaatctgtctctacaacaacaacaaaaaaattaaataagaaatgaggccaggagtggtgctcatgcttgtaatcccagtacattgagaggccgaggcaggcagatcacctgaggtcaggagttcgagaccagcctggccaacatggcaaatc

SEQ ID NO: 403632 - DNA, 3128 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403633 - DNA, 2981 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403634 - DNA, 1585 bp, Homo sapiens
cacttctcaagctgtgaagtggtcctggagctgcggccaggagtcagcgatgtggggttcatggaagacctcgttgttgtgcaggaaaagggtgaccctgtcggggggatactccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403635 - DNA, 1613 bp, Homo sapiens
cacctgtcacccatccagcccctcctgggcctccccattcgcatccttgcagcccccatgctgtcactcctgcccttgccagctcacccagacagcagagagcctggggaaggaaggatagacactgcctccctcctcttctcctgggggcatgggccagttaccccatccacaccgcctccccacctgccgccgtctcagctcgcctctcacctccagggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403636 - DNA, 1829 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctgacactcaaccactctgccaaacctgccctgccattgtgcctttttagggggcctggcccccgtcctgggagttgggggatgggtctctctgtctccccacttcctgagttcatgttccgcgtgcctgaactgaatatgtcaccttgctcccaagacacggccctctcaggaagctcccggagtccccgcctctctcctccgcccacaggggttcgtgggcacagggcttctggggactccccgcgtgataaattattaatgttccgcagtctcactctgaataaaggacagtttgtaagtcttga

SEQ ID NO: 403637 - DNA, 2728 bp, Homo sapiens
cagcccctggagcttctccgggcagaagaggaggtgggctggactgtcaaagaaagtggctggcttccgtgggcaatccgaggttcctagtggccctctgcagaaagctgaactcccagttcccccaggcctccgtcccgcggcggactcctaggcttcctccctccctgtcgccgccagcctctcgctctccccgtcttccgcccgcactctctgggcagggctgcggccaggacccgcccccgcgtcccgcccgaccctccgccaggggtcacttcccctgtccaggtttcagcttccacatgtgtcaagcggctggctcagcccagagtccctgtctcccgcccgccggcccgagccgccgcccctcccccgcctcccgtgcgcccgggacaatcctcgccttgtctgtggcgccggcatctggagctttctgtagcctccggatacgcctttttttcagggcgtagccccagccaagctgctccccgcggcggccgcacagcagcccgagcgccccctttccagagctcccctccggagctgggatccaggcgcgtagcggagatcccaggatcctgggtgctgtctgggcccgctccccaccatgacctcctcggggcctggaccccggttcctgctgctgctgccgctgctgctgccccctgcggcctcagcctccgaccggccccggggccgagacccggtcaacccagagaagctgctggtgatcactgtggccacagctgaaaccgaggggtacctgcgtttcctgcgctctgcggagttcttcaactacactgtgcggaccctgggcctgggagaggagtggcgagggggtgatgtggctcgaacagttggtggaggacagaaggtccggtggttaaagaaggaaatggagaaatacgctgaccgggaggatatgatcatcatgtttgtggatagctacgacgtgattctggccggcagccccacagagctgctgaagaagttcgtccagagtggcagccgcctgctcttctctgcagagagcttctgctggcccgagtgggggctggcggagcagtaccctgaggtgggcacggggaagcgcttcctcaattctggtggattcatcggttttgccaccaccatccaccaaatcgtgcgccagtggaagtacaaggatgatgacgacgaccagctgttctacacacggctctacctggacccaggactgagggagaaactcagccttaatctggatcataagtctcggatctttcagaacctcaacggggctttagatgaagtggttttaaagtttgatcggaaccgtgtgcgtatccggaacgtggcctacgacacgctccccattgtggtccatggaaacggtcccactaagctgcagctcaactacctgggaaactacgtccccaatggctggactcctgagggaggctgtggcttctgcaaccaggaccggaggacactcccgggggggcagcctcccccccgggtgtttctggccgtgtttgtggaacagcctactccgtttctgccccgcttcctgcagcggctgctactcctggactatccccccgacagggtcacccttttcctgcacaacaacgaggtcttccatgaaccccacatcgctgactcctggccgcagctccaggaccacttctcagctgtgaagctcgtggggccggaggaggctctgagcccaggcgaggccagggacatggccatggacctgtgtcggcaggaccccgagtgtgagttctacttcagcctggacgccgacgctgtcctcaccaacctgcagaccctgcgtatcctcattgaggagaacaggaaggtgatcgcccccatgctgtcccgccacggcaagctgtggtccaacttctggggcgccctgagccccgatgagtactacgcccgctccgaggactacgtggagctggtgcagcggaagcgagtgggtgtgtggaatgtaccatacatctcccaggcctatgtgatccggggtgataccctgcggatggagctgccccagagggatgtgttctcgggcagtgacacagacccggacatggccttctgtaagagctttcgagacaagggcatcttcctccatctgagcaatcagcatgaatttggccggctcctggccacttccagatacgacacggagcacctgcaccccgacctctggcagatcttcgacaaccccgtcgtgagtggggaccccacgcccagagcacacaggttccccgccttgtgctaaggaagacaccaaacgtgatggctgctgccagcgcaggacactgagtgggagggggcggtcccctgggggctgggagcgaggggggcacagatctgatgtgccccccaccctctcacaggactggaaggagcagtacatccacgagaactacagccgggccctggaaggggaaggaatcgtggagcaggtgagcccacgcagcctccccacccaccccctgccctcatggccatcgcctcttgggggcccccgcctggattcaaagttttcacactgagttccccagagatctgagggttttctgttcagacaagatgaaggcagaggccgaacagaaaggactcttgcccccaaagccagcattgatcagacagcctcttctcctgtgtattgggtatactggtgttatgcttgaaatcacattttgggaggccaaggtgggtggatcggttgagg

SEQ ID NO: 403638 - DNA, 431 bp, Homo sapiens
tctctcaggaagtgattgtagagcagaaggacagaggatgagagacctaagtggaacctgttgcctaaagaaacatgacagacattaagctagtgatgagagcagagaattggttatttaaaacctacaatattttttataccttctcctgaattaacagtcttaataatttctgatggttggaataacattgtcccaataactctatcattgtctgggtgacctcatagcatacacttggcccattcaaaattaaattggttcttattttcagtaaatgtatgtatctcataaaattagaggaaataatatgcatatagtgtctggatctggaaaaagcagaacttttttttagctttttctgtctagcttaacacagcctttcaacattcttaagaagtacctttagggtattattctagttatataga

SEQ ID NO: 403639 - DNA, 460 bp, Homo sapiens
gagataaaagtcaggaatcctgattcttcaactgggatttagtttatgtggtctcatactgatatgaaaataagtgatctgatgcaagcttagaaagatggtgaaaatagcagttaatgtattttattcacatgcccgcgttaagtcagcctatcttgacacaatggttatttagtatgatgttaggaacattcttttaagccaaatctaaaatgcatttgtttttacagacagaaataaatttgaaatttgcaaaagcccattttaaaaataaatttgttgaggtcttcctactgcaagtttgtacatgattgcatattttaccagtgctgtatattgtaatattaaatgttagattttttttaacatgccagacttcattttatcagcctaagcatttgcacttaaataatatcaggctttggttaaataaaaattttagcagaaatagatcgaccca

SEQ ID NO: 403640 - DNA, 411 bp, Homo sapiens
caactatagacaggatgctgtctgagtgctctcagatggcaagtttgtcggaaaaagaattcaagactcaagtcttagccacataacggggaaatacaatcagcagtcaagagaaagaggagacccaaccagccatccaaaacaagagtgttcagaggatgcctgaaagctacaggtatggagacaggacaagctagagaagctgatcatgtttcagcaggggcaggtgaattacgttaatataaaaaatgtcaattttttcaaaattaacccaaagctggaatgcactgtcaatcagagttctaatattgcatttcggggaattggatacaattattttgaagaatgaacaaaagaactgataagaatagtagtagtacaccaacaacagtcaaaccaagagctaaatca

SEQ ID NO: 403641 - DNA, 894 bp, Homo sapiens
  misc_feature (10)..(10): n is a, c, g, or t
  misc_feature (174)..(174): n is a, c, g, or t
  misc_feature (683)..(683): n is a, c, g, or t
cagtgcccangaagatgatcctaactttcccaatgaggacagattacagtgtcagcaggatgaatgtgcctgtgtaatgcatcaggaatgtcaaatccagccctctgagctctcagtgactcaggaacccaggccttctgccatgacatccttggcatcactgctttgattatntcacaagctttgtctgcttgtctagaaagtggaaacctcccagaagaagggtcagcgaccacgctgaggcaggaggtagtgctcaggctccaagacctggcaataaagtgcagcctctctaaagcctgtagcaaattgaagttaggctgaagtgagatttgatctagattggtggtatctaaaattcatgtttatttcactcatgtattcagttggcttaaccttctctgacttctctgaggatgaaagccttacaatttcatcatttcgggtagtgggtactgtctcctggtatcgacaaccaaatggagacccctcatatccagctcctctcatttttttttttttttgcctttggccagagattcattttgcattcttcatctttagtactttattgaaattctgccactttctacctgttttggataagccttggtgtggtggttgctactattcttggacaggatacagttattgcctcctccatctctaaacaatgtttgtgnttttttttttttttttcactcatgagtaagatacctgtctctttctgaagtgtgcctctgatgttctctagccatctttattgaaacataggctggatgcagtggctcatgcctgtaatctcagcactttgggaggatgaagtgggagaaggatcacttgagcctaggagttcaagaccagcctgggcaacattctgagacccctgtctct

SEQ ID NO: 403642 - DNA, 471 bp, Homo sapiens
atggtgacttctgcaattcatttggctccttcgattgttgtgaaaaatagaatgtcctatggcatcctctgtgtagttgattccctgtcaaaacactggggagtgagagaggatttttcctaatatcaatagctcatgtatgtcaaaaggacacaaatgacattagactagtataagaaaggcttcttaaggacataagaatatatgctaaagggacataacatatgctgtagttattaaacaggtatgcacatacaagtgcacaatgaacagtccttatgagttgtgacattctgatataagcccgctttaaacacgtggctagttactattcctaacaggctccttctctcttcttggcctttttcttttggcttgaacttggataagaaccttgggtaccttattgtacatctgtcactgcctctagcttcagctgatccaaatctgccactaaaaattgaagttttc

SEQ ID NO: 403643 - DNA, 500 bp, Homo sapiens
ttcccctcctctccatcaaccacaagagtaccttgcaaccacaagagtgcaggagagggagacagactgtgcttctaacaagaaataagggactaaaactaagaccaccaagagttaagcggagaatcaaaccatgactagtgtaggcagatcaggatgcactccacagccaagctagtcttcctaacaaaaactcaaagacccgccttggccaggtgcagtggctcacgcctgtaatcccagcactttgggaggttgaggcgggtggatcacctaaggtcaggagttcaagacagcctggccaacatggtgaaaccccatctctaccaaaaatacaaaaattagctgggcgtggtggcaaacgcctagagtcccagctactcaggaggctgaagcaggagaactgagaatcatttgaacctgggagacagagggtgcagtgagccaagatcgcgccactgcactccagcctgggtgacagagaaactccatctcaaaaa

SEQ ID NO: 403644 - DNA, 324 bp, Homo sapiens
cttcatgtctatttgtctcccactttccataatgacttccatatggtgataaacatgatttatagctgtgttttttagttaatatgtgtgaattgtggctctctaacacgcctccttgtttttactttgcaatctttcataggaagcgtgttgttctctggcactgagcaccccccaaacgctgggcaaaatgaggctgaattcacagccgctgagtttcccacaggccaaccacaccattgctccaaaagaccttgaagttccctccttccacctcctccacctcttaccttccttcttcctctcacacgctgacttggccag

SEQ ID NO: 403645 - DNA, 246 bp, Homo sapiens
ggagagaccctgaagttggagagagcctgaacccagagagatctgcagacaggcctggggtggggaaggatttcagcaaaaagagctgtgaccaatgaaatgctgcccagtttatttcatattcctctctgtgttactttgatctttgttgttttaaatgtggtcaactagcttttacattactgacttagtaatgttttctctagaattttaaccttttttgggggatgtggggaggttttatag

SEQ ID NO: 403646 - DNA, 348 bp, Homo sapiens
cttctttcagatctgattgtcagctccttgataactggtatcacatggacatcctccagttgggctccctcattcaaagcctggctctacattcacaagctgtattatgttgagaagttacaatcgaagtagaacctgtttcaccatctgttaaaggggggaaatactaccatctacatcatggggtggtagccagaatcaaataagatgatagatgagaagtgctggctctaccctgctatctaattcttgtcactttctggctgaaaggcaatggggccagcaacctaggttttgaagtttgctttactcattggaaaaataaatgtaacactcaacccttgggaa

SEQ ID NO: 403647 - DNA, 428 bp, Homo sapiens
tgttggcattacagctcatccaacgccatcaagttagagtgctcgtgtctcctctcagctatttaactgtgcccctgcaaaattgttcagaatgaaaccagaaaaatctgcctcttttgcactgtagatgtctcttccatgtgccaaatgtggagattagatgctacaaatgaaagccaaataaaaaagaagtatctgacaaaagcatgggttagagggctttcctaatctgtgtgaggtcaatccaagggatgtttacatactgtagataacctacttgaacaaaaatcagtattatagagaataaatggatgtaagaaaattacatgtacaagttttgtatatttgttaataattttggtaataaatatgatgtactgcatctcagtaccttagcacttcttttaataaaagttaaatagaaggaa

SEQ ID NO: 403648 - DNA, 266 bp, Homo sapiens
aaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggt

SEQ ID NO: 403649 - DNA, 553 bp, Homo sapiens
gatgagtgtattagtcttctcagacttccataacaaaatagcacaaactgggtggcctaaaaagcccacagttctggaggctaaaagtccaagattaaggtgctggtagggttgacttttggcttgttaatggctgccttcttactatgtcctcacatgacctcttgtctgtgtgtgccggaaaagagagcgcatgatcttgggtgtctcttccttttataaggacaccagtcctattggattagcccctacccttatgacctcatttaaccttagttacctccctaaaggccctgtttccatatacagttcacattaagggttgggacttcaacatatgaattggggtggggggggcacaattcaatctatagcaatgggaataaaaaaagaattaggtaatgtatggagaaatgtattattttaaagtaaagaagatatactcagatgataacatccctcatttctgtgactagtcatgtggccatagccaatatttataatttccttcccctactatgcatttcatattctctttgcctttggcaagcat

SEQ ID NO: 403650 - DNA, 456 bp, Homo sapiens
atgggttcctgagctctctactgttaatagaacttgctctctcgcaggccaatgcctcaccaggtgattgaagcagagaaacttaggtggtgaaaggagaagatggggcctgtcctgagagtttctgttcctgagatgctagaggcagagggtccctaaactttcctgagtcggcagacatcccctctggagaagaggttggccccagagtcgaacatcctctgatctacctgatcctgctgcccttccattccacttccccacatctgttctttctggtcgtgtttactcccctattaaaaaaacaaaaccagaaaacgtgtttgcctagatcttgagactctggaagatcttaacagtcagaggttccccctatttgcaatgatctcctttcctgccccttcctatccttgcaataatccttttgaataaagtctctccttactaaatccagtt

SEQ ID NO: 403651 - DNA, 486 bp, Homo sapiens
atatgatccttaattagtcctaaaaatcctaacttcagtaacaacagaatgtggacaaattgaaagcctgccagtgctctcaaaaacagtggatggtgtggtggaaagcccttggaaggagatgggtggatgcatgggagatgcaggctacactgcagggctgctggcttgcaggagagaaccgagaatgagggagagctggggaaagttctcttgtggttgaaacaaatgccagacactcttcaatggagcccatgtttgtttggttcagtctgtgaagtaattcaaacctcagtgcatgattgaaaatagtacaattttccatctgcaagtggcagccctggatgactggatggtctataattgggacacgtatctagactcaacgatgcctggatggaaaatgtgcaggctgctccactgatgtcagctgtttcatcacagttttatgatttaataaaagtcatattttttttcatttttgca

SEQ ID NO: 403652 - DNA, 365 bp, Homo sapiens
gacctactatttgatagcacaatgggatgactatagtcaataataacttaattgtacattttaaaataacttgatgtaattggattgtttgtgactcaaaggataaatgaggggatggatacaccattctctatggtgtgcttatttcccattgcatacctgtatcaaaacatctcacataccacataaatatatacacctactatttacccacaacaattttaaaaaaaatacaaagattaaaaataaaacaattaaacaaaaaaatgacctcaggagaaatgattagacagagtatgtcaatcaggacaactaacgaaggtttagaaacagtttaccttttaaaatgtttctttacaaatgac

SEQ ID NO: 403653 - DNA, 217 bp, Homo sapiens
agaaaccttggtatcttatttttgctgcagctacttgttttagagaaaagagaaaacattttcatttcctaacacacttctcatttcctatactctttcttcttgtagatctgagtctccatattgtatcctcttcagcctgaagaaatttatttatttatttatttatttatttattttgagatacagtttcactcgtcgcctaggctggagtgca

SEQ ID NO: 403654 - DNA, 625 bp, Homo sapiens
tctttttttaaagagacaaaataaggctcagagaggttaagcaaattccccaaggtcacacagctaggaaatggccaagctggcatgtgaactgagacagactaatacctgtgctttcagctgccatacatttttactctagctatcacttgcattattaagaatctaggctaagtcactaaagatatatcattacttatttcttgttcattcatttgtttattcagtcatttattcattcagcaaatatttactaagcgcccactatgtgccagccactgctctaagtcccgataatacaacaatgaaaaaaacaaagttgttgccctaatgcaggttacattcaaatgaaggagggggaaatgaaaaatcagggtaagaggataaagaatgacatagtggggagatgggacctctttagaaaaggtgaccagagaaagcctctctgagttgatgacatttaaggagagatgtgcaggatgtaaaggaacaagtagagtgctgcaggctgaaagaagaacatttgcaaaggcccttaggtagaaacaagcttggcatattatggaaacagcaaagtccatgtagctggagcctatgaatgggaggaaagggcagagcatagcag

SEQ ID NO: 403655 - DNA, 679 bp, Homo sapiens
tctttttttaaagagacaaaataaggctcagagaggttaagcaaattccccaaggtcacacagctaggaaatggccaagctggcatgtgaactgagacagactaatacctgtgctttcagctgccatacatttttactctagctatcacttgcattattaagaatctaggctaagtcactaaagatatatcattacttatttcttgttcattcatttgtttattcagtcatttattcattcagcaaatatttactaagcgcccactatgtgccagccactgctctaagtcccgataatacaacaatgaaaaaaacaaagttgttgccctaatgcaggttacattcaaatgaaggagacatacaataaaaaacaaatatgcaacatgatgtcagattatgatagctgttttggggaaatgaaaaatcagggtaagaggataaagaatgacatagtggggagatgggacctctttagaaaaggtgaccagagaaagcctctctgagttgatgacatttaaggagagatgtgcaggatgtaaaggaacaagtagagtgctgcaggctgaaagaagaacatttgcaaaggcccttaggtagaaacaagcttggcatattatggaaacagcaaagtccatgtagctggagcctatgaatgggaggaaagggcagagcatagcag

SEQ ID NO: 403656 - DNA, 147 bp, Homo sapiens
attaacttctgtcatcatttttagcatggaacttcaacagtttagtcctaaagaacaactttaggaaagttgttctttcttttaggtcatatatggtgttcattccaacatcattcttctgtaagaagtttctcacttacattattg

SEQ ID NO: 403657 - DNA, 149 bp, Homo sapiens
tgcaagggactgaccagttatgataaactgcttcacctctatgaatctcaatttcctcagctgagaagtcatttggaataggttggcagatctcaaccctcactgcacattagaatcagcctgggcaacaagagtgaaactccatctca

SEQ ID NO: 403658 - DNA, 466 bp, Homo sapiens
aagctagtatcattgcaactttggtttgtaactccacatttttcctacataacaagagactaatgcatttaaacgaattgtttatgttttggggcacagcatgaataaagatgtagttttgtgacatcagcaaatgaaaggggtgggaacagatatgtaaaggagcagagtttttctgtgttactgaagttaagctggcataaatttaaattagaatgttattactttaggatgttaaatgtaatccccatggtaaccacaaagaaaatagctatagaacatacacaaaaggaaatgagaaaagaatttaaacattccactataaaaaatcaactaaatataaaagaagacagtagtgcaagaaatgagggacgaaaaaagctataatacgtgtagcaaacatagcaaaatgacagaagtaaatcctcatcaatagttgttttaaatgtaaacagatgaagatttc

SEQ ID NO: 403659 - DNA, 465 bp, Homo sapiens
taatatagatttatttttgcacccatgctgttgattgctaaatgtaatagtctgatcatgatgctgaataaacaacctttttttctttaatatgctgtttaaagttagtctactctgaagccatcttggtaaatttcccccaacagtgtgaagttagaattccttcagggtgatgccaggttatatttggaatttatatacaacctgcttggatggagaagccattgtcttgagaaaccttggtgtcgttgaactgacagttactgttgcgacctgaagttcaccattaaaagggattacccaagcaaaatcatggaattattggttataaaaataattgttggcacatcctatgcaatatatctaaattgattaatggtaccagataaaattatagatgggaatgaagcttgtgtatcatccattatcatgtgtaatcaataaacaatttaattctcttggaaa

SEQ ID NO: 403660 - DNA, 449 bp, Homo sapiens
tagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagttta

SEQ ID NO: 403661 - DNA, 3112 bp, Homo sapiens
  misc_feature (1626)..(1626): n is a, c, g, or t
  misc_feature (1981)..(1981): n is a, c, g, or t
  misc_feature (2412)..(2412): n is a, c, g, or t
ctaggtttgagtcctggttctaccacttacaacccagtgaggatccccagagggatcagtcccattgtacatatgagacaacaggttcagaggtgctaagtgtctcagccaaggtcacagagctagttaggggcagagctgggatttgcacataggccaactgtctaaagacccagtgggctcatatgccactatgggcagaacttttccggaacagcccccagttttcctggcagccgtaaagggaacctgtagttttctaggggcaatatcagttgttacaagatctgaatctttgatgtctaatgagctgggcctagcctcagtagaggactcctgctccacattccaccaagggaaacaggcattacggcccctacccaggacagctggtgccaggaatccaactttccccataggacaatggacctcccttaaacttgtctatttatttatttattttaaatagagacagagtctcactcactatgttgcccaggctagtcctgaacttctgggctcaagcagtcctcctgcctcagcctcccaaagtgacaggattacaggggtcagccactgtgcctggcccctccttaaacttcttttccagagactctagaatctttctttttggtggaaaacaataaaagatttggcactccacatggaatgcggcaggagactgcagtgggtgaactcccccggtcccttccagccctgggccctgctgcctgccctgccctgcacaccagccctgtaaggcatctgctgtcccaggggacctttgacaggccctccagcccatagtcagctcttccctgccctcccttgtaaagatagatgagactggcagctgcagtgcctggtatcaggaagtccctaggtggctggagggagtgggccagagccccagttcttggtgggacagcttcatgggaaatgcaggggaatgttcaggggctctgagacatggtggaggcgggtggggggactgatgcaggatgcggatggacaggtggtaaggagtttgtgcatgagagtgggactgggagatgtcacatatttccctggggctttcctggtaaatataactttggtcaaggagaaaccagcagtaggccacagcctaggccaaggtaaaaatgctgtcttctaatgagctccagatccacacagactgtagctttaatgtcctaggggactttagccaaggcctagaaaaagtctcctagaagcagagtttggagaccccatagatcctaccctcagccaggagctcgagctaggggcattccggatgcctccagatgaaaagactgcacaggtatcaccaggccacattgaggggacgtagcaagggtggcatcaaaccgtcggaactgccatcacctcggtcttgctttgggaaaggaacaaatacttctgaattcacggcagtggtatcacctgtgagggtgcagtcaatgctagtcagccctgccctccttggctctgccctctcctaggcgagtgcctggaaagtgacctctgcaagcacaggcagactcatcttccaacctcctgctggagccattctccccagggtctgtctgcagacttcctcccttgcagctacatgggtccaantgactctgcagagagggagatgcctcctcctcaggtgatgggtcacaggaaggaagaaggtgacctcagtgggggacggtgtgggctggcaaggtatcagtgggctgtggttgccgaatgcagcacacagaggctctggcccttgctctcagcaagttctcattttaaactttctggatagacaaataatccttttcctctcatcttttgccaatggaggtggtgaaatgttctctcctctgtttaatcagataagacttctaaagaaagcagcatcagaagggccaaggtaagggagaaaatgctgtgctctgcccatctgaacctatcaagggcattaaacttggatcctaangcacgtggcagacacagagcaacatcatgtagccataaggcctggaggagatgggggcaaggagccgtttcttactctgagcccaatcactaggtacctcaatgtgtcacaggtcagtaccggctttcagaggtcatcctttccattcccctgcctccaaccagggactcccaaaccacccctgcgggcttcccctaaccctaatgcttttcgcaaagggaaaaaataactgttgctacctagttttctcatcaagaggcctgtggacctttactgcatggaagttctttgttatatctaacctaaattcctcctgctataagggatagacagttgagtaaggtctagcgacagaaacacaggcaaaaataacctctggaggtcaccgggatgtaccatcaattctggaagcaagaagaagttttcctagnctccctttcagattagcacgaaggaagcagctctgctatgtgccggctccgaggagctcagctcaacagaaatcccagccctgggaggactctgggctccttctccttttaaggcaacgtttgagtgctcagggctacacaagcggcaacaagctccagcccctctcattcctggctatttggaggaaactgatgattaatcaaccctttccctcccacccccagcctgtttttcattaggttctttttaaagtgttggcacacctcctcaagaacagacacttggcagatccttgccaactaggaccccagggtaggggaggtaactaggaaggagtggggagtagtcctggattaggataaaggggagaagtcaggatgtgcggtgtcagggaagaaagaaggttaaattgaggctgggcgtggtggctcgcgcctgtaatcacagcactttgggaggccgaggcaggtggatcacctgaggtcaggagttcgggaccagcctgaccaacatggagaaaccccgtctctaccaaaaatacaaaattagctaggcatggtggcatatgcctgtaatcccagctacttgggaggctgaggcaggagaatcgcttgaactcagaaggcagaggttgcagtgagccgagattgcggcattgcactccagcctgggcaacaacagtgaaactccatctcaaag

SEQ ID NO: 403662 - DNA, 637 bp, Homo sapiens
  misc_feature (434)..(434): n is a, c, g, or t
  misc_feature (456)..(456): n is a, c, g, or t
  misc_feature (469)..(469): n is a, c, g, or t
  misc_feature (519)..(519): n is a, c, g, or t
gtgctacagaggatgcaacaggacttaatagtgtccactggttttagtaacagaggtaattaatgttccagaaaacatcctggaccttaaacttccccagagttggttcttaaccttcccttatatgctcacctcctatgtcaaactagtggattccatcttgtggtataaactgtctattcgctgaagactactgaatttatatctctagcttggatctctcccctaagcacacactctcgtgtccagtggtcttgctttctccctgtggatgtcagaaggttcaaggccagtttctttatttccagtgctccaaactggttccttctgtagtataccttatttgtaattgctcttatcaaaaactgaagtcatttctgattcctctctagggacctgctgcttgccataccttcccaagccactaccatctnctgcatggattattgccatcgncactcgcctttgngaagaggtgaaagccaccagccttgaggaaatcgacggggacaggctcgncgacttgcccctaattttcgatgggccatacccaataggcagatcaatgatgggatgcggtgagattggagagattatgaatattcaatgaggagatgagagaattcagacgaaacct

SEQ ID NO: 403663 - DNA, 222 bp, Homo sapiens
agagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcggttagttatggttgtgtcactgcactctcaccgaggtgacagagtgagaccccctttctttaaa

SEQ ID NO: 403664 - DNA, 952 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaagtgcccagccctggataggcagtgcggctgaaaaaatgtcctggtgaaagggaggaggagctcactgaagaccttctgctcccaagtgtgagactagaacccaggcctccagccttctcacaggtgcccttccaggacatcgtgtggctactccaggcagcattcctccattgcaagcagggaggagtatctctgcttccctctgtgacctcccaattgcacagaggcctctagtgacaagttctgaagtcatgcagtcctcccctgtctccaagcaggagaccctgaatccacagccttcagggacatacagtccctgaacacctacctcatgcaggcatagagcctggtacttcacacaccttggagtcctcatggcaagtttttgaaatcagtgttattacctactttttgtagatgaggaagctgagatctggagaggctaagtgactttcccagggccatacggtgagttaaggtggtgtttaggc

SEQ ID NO: 403665 - DNA, 1126 bp, Homo sapiens
tcagctcgtccggaagcgtgaatggccaattcccaggccctaaacaaaccttgggcacttgagccagtcctgctgtttccttatggcccagtctgcttccccttcatagaagggagtttttcctactgctgctaggttatgtcatgaccagggaccacatcccctctgtggagagggtcccaggcccagagaggatattggctgcagcagcagtggccagggaaaggaggaaggggatgctcttcctcaaagcttggggtggagaggacagtgctggaagagagctgtggctgactgttcctccctcctcagcttcccccaaatgtgggtacaggaagagcaagagagaaatgcatccctccttcagggagaatcaagagcccaaagggacccctagagttaatgaggccacccaggcccctagtcaaaggcaacaggctaagcaattcatcagactgagggggctgaaaccagggctcctcaggggtgggagagacctcagcagccttcccacctagtgctggggctcacgccttagcccacccaggacctccaccctgacccacaccgcaggccccacggaacccaccagctacgagcctttccctcagcctcccctccattaaacataccgtgtcccccaagtgctctctcggggccagaagaggtttcctggtaccactcctgacccctggagggttgagaactgaggaccctgggtcccaccatgctcagggaatggaagctctttggtcagtcccagcagtcagaggccctccccacaggagaccacttctgcaggtcccctggatagctctgcctcaggcaagggccttactatggcttgagagatggtgtagtccctgtacaacagcctggcttattctgccactgcggccacctcctcttcctcaccctcctcctctgtctctgtcttgatctgagcaacccaaggcggtagagggtgtcacgaatgaccacctcaccaggctggcagctctgtacaatgtcatggatctgacgattgacaatttcgcggctggtgaggaagtccatgaggcggttgtagaggtaatagtgagtggcattgtcgaaggcaatgggccgctggcggacaccgtttggt

SEQ ID NO: 403666 - DNA, 10163 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403667 - DNA, 7613 bp, Homo sapiens
agcaggttggttgaaaagtcttgatccacaggctttcctactgggatagactgaaggaagatgagtgagtgtgctctcctgtgatgctcctttacccccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403668 - DNA, 9785 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403669 - DNA, 9651 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttggtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403670 - DNA, 10138 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtgagatggcagctcatcactccacagcttcctatcacagggcctgtgggggttgcagggagcccatgggcccttggacagaggccctttggtgcccaggacttaagggacctgtgtgcgtggcagccacggcccatgctgatgagaaggaggccctcatgtccgagctgaagatcatgagccacctgggccagcacgagaacatcgtcaaccttctgggagcctgtacccatggaggcatctcttgaggactgttggaagtgcaccacctcaggcccatccacccaggcctgctgattcaaaatctgcattgcagagattcccggggtgatttatctgcacatgagttgcagcggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403671 - DNA, 11103 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggcatgtggctggccacaccaagcaggaagcacaaactcccccaagctgactcatcctaactaacagtcacgccgtgggatgtctctgtccacattaaactaacagcattaatgcaaaaaaaaaatggttctttgtgccacatgagtacctgcaaattccctggaacgtctttctttccttccctccttcacatgaagtgacgagctcacagctgtggagcttgaccacactgtgccccatacgatgtgcacggaattgactcctgctacaccaaaaccagataatttaataaactttattcttgttgggggaagagggagggaaaaaaagccacctactccactcaataaattaacacatggccaattcccaggccctaaacaaaccttgggcacttgagccagtcctgctgtttccttatggcccagtctgcttccccttcatagaagggagtttttcctactgctgctaggttatgtcatgaccagggaccacatcccctctgtggagagggtcccaggcccagagaggatattggctgcagcagcagtggccagggaaaggaggaaggggatgctcttcctcaaagcttggggtggagaggacagtgctggaagagagctgtggctgactgttcctccctcctcagcttcccccaaatgtgggtacaggaagagcaagagagaaatgcatccctccttcagggagaatcaagagcccaaagggacccctagagttaatgaggccacccaggcccctagtcaaaggcaacaggctaagcaattcatcagactgagggggctgaaaccagggctcctcaggggtgggagagacctcagcagccttcccacctagtgctggggctcacgccttagcccacccaggacctccaccctgacccacaccgcaggccccacggaacccaccagctacgagcctttccctcagcctcccctccattaaacataccgtgtcccccaagtgctctctcggggccagaagaggtttcctggtaccactcctgacccctggagggttgagaactgaggaccctgggtcccaccatgctcagggaatggaagctctttggtcagtcccagcagtcagaggccctccccacaggagaccacttctgcaggtcccctggatagctctgcctcaggcaagggccttactatggcttgagagatggtgtagtccctgtacaacagcctggcttattctgccactgcggccacctcctcttcctcaccctcctcctctgtctctgtcttgatctgagcaacccaaggcggtagagggtgtcacgaatgaccacctcaccaggctggcagctctgtacaatgtcatggatctgacgattgacaatttcgcggctggtgaggaagtccatgaggcggttgtagaggtaatagtgagtggcattgtcgaaggcaatgggccgctggcggacaccgtttggt

SEQ ID NO: 403672 - DNA, 8404 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagttcacgcccatgctgatgagaaggagccatcatgtcgcgagctgaagagggagcagcataaggatcctctaagtcacc

SEQ ID NO: 403673 - DNA, 2322 bp, Homo sapiens
tgtccctagagcccatggcctccactgcctgcctgcccacacaaagaccatgtgcaatgtgatcagaagctgagaggaccaggccagagggctgtgggagttcagaggtggacggacttttcaggctgaagcccaagtaccaggtccgctggaagatcatcgagagctatgagggcaacagttatactttcatcgaccccacgcagctgccttacaacgagaagtgggagttcccccggaacaacctgcagtttggtgagatggcagctcatcactccacagcttcctatcacagggcctgtgggggttgcagggagcccatgggcccttggacagaggccctttggtgcccaggacttaagggacctgtgtgcgtggcaggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403674 - DNA, 1456 bp, Homo sapiens
  misc_feature (25)..(25): n is a, c, g, or t
aagcaggcggtacggcctggcgtanggatatgggatctcactatgttgtccaggctggtctggaactcctggccttatgcaatcctcctgcatcaacctcccaaagtgttgggattacaggaatgagccactgcacctgtccctaaacagacttttaagagatcgttattacagttaccctgaggataccaaaatggcctcatctgtcagaatgagggtgatgagagtacccttctgcaagggttactgtgaggattaaatggtaaagcatgccaaggacttggcataggttttatactaaacttactttgactgggtttggggacctctgctgggtaggtctctctaggggtgtgtgttaatggcccctggaccctagggagctgcccatgggcatcctctgtcctatctcccagatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403675 - DNA, 5199 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttggtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403676 - DNA, 816 bp, Homo sapiens
ctgggtgacctagagtatccccgatttgacgcttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403677 - DNA, 5007 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403678 - DNA, 444 bp, Homo sapiens
  misc_feature (32)..(32): n is a, c, g, or t
atcaggacaccagtctttgctctttggggtcnttactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403679 - DNA, 3173 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgccagatttcttgattccacctgtggccaagggccccttccccgcggccttcgcttttagctcctcgagtttcttctgctcctcttttggtttctgcttgaaagccttatc

SEQ ID NO: 403680 - DNA, 2261 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatggtgatgagcacgcccctcgccatgtccctgctccttcccctccctgcccccgttccctctcccttcctgcactgtccacccacccatgggaggagtgggagagggagcctggaactcaggagatggattctaggccactgacccactgccgtgtgaacctggcctctgggcctcagtttccccagctgtataaggaggccatctggctagattggtgtttccaaaacttcaggcacttaggtaccaaggccatgattttcccttctcacattccacttatactgtactattaactcgataggtatttattgagcaactaccatatgcctgtctcttcaaggttcttgaacttccctccctgcctttgtgcagcttgcatccaagtaggggaagacaaacactaacagtagggaggaaaaccccagcaaattacataggttagaaggtaactaacactgcgggagaggaaaaacaggggccgggtagggaaggttgagagtgctgggcacagagtgatggtgtgagttgcatttttgatacagtgatcagg

SEQ ID NO: 403681 - DNA, 1124 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccagggtgagccccctttctggcctgatgc

SEQ ID NO: 403682 - DNA, 340 bp, Homo sapiens
aaaaaacactttcagataagaaaaccaactaaggaaatgggattggtggtttttgcatgtctcaatggcaccctgtctgagtatctggcttacccaaggccgttgggccctgaatattttaccaaaaataaaataaacccctttaaggctgttatctgactgcaatcctggcaggggccatactaggctggggctcaccaacaccacctgattctctcctgcaggcacaccttcaccctctctctgccccgcctgaagccctctgaggctggccgctactccttcctggccagaaacccaggaggctggagagctctgacgtttgagctcacccttcgat

SEQ ID NO: 403683 - DNA, 311 bp, Homo sapiens
aggtggtggaggccacggctcatggcctgagccattctcaggccacgatgaaagtggccgtcaagatgcttaaatgtgagtagtccttggagccctccacatctgggccttcacctctccctgcccctccccacacacttagcctctcccagggtggcctgatgctgatttgcaggcactagaggggccatcacactgcagcaggcactgctcccgagtctgggtctggtttgggaaagagcgttcctctccctggcctcctcggcctgcttccccctaccctggcctcttcccctcctcagagtgtgggt

SEQ ID NO: 403684 - DNA, 433 bp, Homo sapiens
ggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggtaagtgctggaaaaagtgggaaccccagccccatgccctgtccctttgccctaacctgcatctcttcgagtaggtaaaaaa

SEQ ID NO: 403685 - DNA, 5711 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403686 - DNA, 7458 bp, Homo sapiens
gtgactctaccggagcttagattcgtagatcatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403687 - DNA, 4002 bp, Homo sapiens
ggcccaactagctagctcccccaagctcggctgccctgccccagactgcgacccctcctcttgggttcaaggctttgttttcttcttaaagacccaagatttccaaactctgtggttgccttgcctagctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403688 - DNA, 5453 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagccccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403689 - DNA, 2104 bp, Homo sapiens
tgtccctagagcccatggcctccactgcctgcctgcccacacaaagaccatgtgcaatgtgatcagaagctgagaggaccaggccagagggctgtgggagttcagaggtggacggacttttcaggctggtgggtaagggagactgcctggaggaggtggcttggcattggtgggacgggctttggaggatgaggatgcagcaggggagatgacactaagggaaagggtaccctctccctgtctttgggactgtggttcttcctcccagccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403690 - DNA, 5333 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403691 - DNA, 5086 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactca

SEQ ID NO: 403692 - DNA, 3726 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgatccgatcacgagcttaacacaggtaccgcgctcgacattcgtatatgtatca

SEQ ID NO: 403693 - DNA, 2767 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcggcgttggatgcagtcagcggcgttggatgcagtcagcggcgttggatgcagtctgcggcgttggatgcagtcagcggcgttggatacagt

SEQ ID NO: 403694 - DNA, 400 bp, Homo sapiens
gccctgtccccagcccaatttcaacctcagctccggaaactccatggctggcacggtccccaggcctgaagccccaccccacaggctggcctcctttgggattcagttggtgccctgcccccagggccccgcccctgacggtcaccccttgcagagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtgagcagctcgctctcccatcccattcttgaagttatttttctttgcagccg

SEQ ID NO: 403695 - DNA, 9306 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaaaagaacgtggagaaaaaaattgacaaatacccagaggtcctcaagacccccggactcctggtttgagcccaataaagactgttaattcctca

SEQ ID NO: 403696 - DNA, 11511 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgcaaaaaaaaaatggttctttgtgccacatgagtacctgcaaattccctggaacgtctttctttccttccctccttcacatgaagtgacgagctcacagctgtggagcttgaccacactgtgccccatacgatgtgcacggaattgactcctgctacaccaaaaccagataatttaataaactttattcttgttgggggaagagggagggaaaaaaagccacctactccactcaataaattaacacatggccaattcccaggccctaaacaaaccttgggcacttgagccagtcctgctgtttccttatggcccagtctgcttccccttcatagaagggagtttttcctactgctgctaggttatgtcatgaccagggaccacatcccctctgtggagagggtcccaggcccagagaggatattggctgcagcagcagtggccagggaaaggaggaaggggatgctcttcctcaaagcttggggtggagaggacagtgctggaagagagctgtggctgactgttcctccctcctcagcttcccccaaatgtgggtacaggaagagcaagagagaaatgcatccctccttcagggagaatcaagagcccaaagggacccctagagttaatgaggccacccaggcccctagtcaaaggcaacaggctaagcaattcatcagactgagggggctgaaaccagggctcctcaggggtgggagagacctcagcagccttcccacctagtgctggggctcacgccttagcccacccaggacctccaccctgacccacaccgcaggccccacggaacccaccagctacgagcctttccctcagcctcccctccattaaacataccgtgtcccccaagtgctctctcggggccagaagaggtttcctggtaccactcctgacccctggagggttgagaactgaggaccctgggtcccaccatgctcagggaatggaagctctttggtcagtcccagcagtcagaggccctccccacaggagaccacttctgcaggtcccctggatagctctgcctcaggcaagggccttactatggcttgagagatggtgtagtccctgtacaacagcctggcttattctgccactgcggccacctcctcttcctcaccctcctcctctgtctctgtcttgatctgagcaacccaaggcggtagagggtgtcacgaatgaccacctcaccaggctggcagctctgtacaatgtcatggatctgacgattgacaatttcgcggctggtgaggaagtccatgaggcggttgtagaggtaatagtgagtggcattgtcgaaggcaatgggccgctggcggacaccgtttggt

SEQ ID NO: 403697 - DNA, 9783 bp, Homo sapiens
tcctgaggctgccagcagccagcagtgactgcccgccctatctgggacccaggatcgctctgtgagcaacttggagccagagaggagatcaacaaggaggaggagagagccggcccctcagccctgctgcccagcagcagcctgtgctcgccctgcccaacgcagacagccagacccagggcggcccctctggcggctctgctcctcccgaaggatgcttggggagtgaggcgaagctgggccgctcctctcccctacagcagcccccttcctccatccctctgttctcctgagccttcaggagcctgcaccagtcctgcctgtccttctactcagctgttacccactctgggaccagcagtctttctgataactgggagagggcagtaaggaggacttcctggagggggtgactgtccagagcctggaactgtgcccacaccagaagccatcagcagcaaggacaccatgcggcttccgggtgcgatgccagctctggccctcaaaggcgagctgctgttgctgtctctcctgttacttctggaaccacagatctctcagggcctggtcgtcacacccccggggccagagcttgtcctcaatgtctccagcaccttcgttctgacctgctcgggttcagctccggtggtgtgggaacggatgtcccaggagcccccacaggaaatggccaaggcccaggatggcaccttctccagcgtgctcacactgaccaacctcactgggctagacacgggagaatacttttgcacccacaatgactcccgtggactggagaccgatgagcggaaacggctctacatctttgtgccagatcccaccgtgggcttcctccctaatgatgccgaggaactattcatctttctcacggaaataactgagatcaccattccatgccgagtaacagacccacagctggtggtgacactgcacgagaagaaaggggacgttgcactgcctgtcccctatgatcaccaacgtggcttttctggtatctttgaggacagaagctacatctgcaaaaccaccattggggacagggaggtggattctgatgcctactatgtctacagactccaggtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctggcacccttttgtgtgctgcctctgggtacccccagcccaacgtgacatggctgcatgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403698 - DNA, 8767 bp, Homo sapiens
ctgaggccttgagggtggaggagactcgaggcttgtaagggccagtgtgagccccactttgttaactaccgtcaccactccaaccccaactgggccctttgggtgaagtggggagaagtggcctccgtgctgaggtctggattcatcaggctgggggtctcagccattgctccctcagtggccactcactcagtccaccggccactcggtcaggcatggagcttggagtctgaccgagctgtggcagccccagcaagggtgtggactcagaggagaggtaagccacaacccagccctcaggggctccagggctaatgggaggtccaggcaatggacaggaactcagaacaggatttgcaccccgtccagagctctggcagcaaggccagactgactggcagggctgaagggacgtggaggccagcagtgatctgagtgggggtagttactgaggggatggagtatttacaggacagtctgaacgtgtggcctagagcgagatgctgagggtctgacactgcaggctgatggggaggtgggcgcttctattctggacaggatgtgtacggagggatctatgatgccaaagatggggtgaggggagggtagctgcccagtttgctcatggcctgctctcatctctgcctccagccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403699 - DNA, 9168 bp, Homo sapiens
catcagtcatcctttccctctctagccccctaccctatccccaagctgaagtgctagtggctggtggtgacttccccagacctaagccaatctctctctaccagtgtcatccatcaacgtctctgtgaacgcagtgcagactgtggtccgccagggtgagaacatcaccctcatgtgcattgtgatcgggaatgaggtggtcaacttcgagtggacatacccccgcaaagaaagtgggcggctggtggagccggtgactgacttcctcttggatatgccttaccacatccgctccatcctgcacatccccagtgccgagttagaagactcggggacctacacctgcaatgtgacggagagtgtgaatgaccatcaggatgaaaaggccatcaacatcaccgtggttgagagcggctacgtgcggctcctgggagaggtgggcacactacaatttgctgagctgcatcggagccggacactgcaggtagtgttcgaggcctacccaccgcccactgtcctgtggttcaaagacaaccgcaccctgggcgactccagcgctggcgaaatcgccctgtccacgcgcaacgtgtcggagacccggtatgtgtcagagctgacactggttcgcgtgaaggtggcagaggctggccactacaccatgcgggccttccatgaggatgctgaggtccagctctccttccagctacagatcaatgtccctgtccgagtgctggagctaagtgagagccaccctgacagtggggaacagacagtccgctgtcgtggccggggcatgccccagccgaacatcatctggtctgcctgcagagacctcaaaaggtgtccacgtgagctgccgcccacgctgctggggaacagttccgaagaggagagccagctggagactaacgtgacgtactgggaggaggagcaggagtttgaggtggtgagcacactgcgtctgcagcacgtggatcggccactgtcggtgcgctgcacgctgcgcaacgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttacgagatccgatggaaggtgattgagtctgtgagctctgacggccatgagtacatctacgtggaccccatgcagctgccctatgactccacgtgggagctgccgcgggaccagcttgtgctgggacgcaccctcggctctggggcctttgggcaggtggtggaggccacggctcatggcctgagccattctcaggccacgatgaaagtggccgtcaagatgcttaaatccacagcccgcagcagtgagaagcaagcccttatgtcggagctgaagatcatgagtcaccttgggccccacctgaacgtggtcaacctgttgggggcctgcaccaaaggaggacccatctatatcatcactgagtactgccgctacggagacctggtggactacctgcaccgcaacaaacacaccttcctgcagcaccactccgacaagcgccgcccgcccagcgcggagctctacagcaatgctctgcccgttgggctccccctgcccagccatgtgtccttgaccggggagagcgacggtggctacatggacatgagcaaggacgagtcggtggactatgtgcccatgctggacatgaaaggagacgtcaaatatgcagacatcgagtcctccaactacatggccccttacgataactacgttccctctgcccctgagaggacctgccgagcaactttgatcaacgagtctccagtgctaagctacatggacctcgtgggcttcagctaccaggtggccaatggcatggagtttctggcctccaagaactgcgtccacagagacctggcggctaggaacgtgctcatctgtgaaggcaagctggtcaagatctgtgactttggcctggctcgagacatcatgcgggactcgaattacatctccaaaggcagcacctttttgcctttaaagtggatggctccggagagcatcttcaacagcctctacaccaccctgagcgacgtgtggtccttcgggatcctgctctgggagatcttcaccttgggtggcaccccttacccagagctgcccatgaacgagcagttctacaatgccatcaaacggggttaccgcatggcccagcctgcccatgcctccgacgagatctatgagatcatgcagaagtgctgggaagagaagtttgagattcggccccccttctcccagctggtgctgcttctcgagagactgttgggcgaaggttacaaaaagaagtaccagcaggtggatgaggagtttctgaggagtgaccacccagccatccttcggtcccaggcccgcttgcctgggttccatggcctccgatctcccctggacaccagctccgtcctctatactgccgtgcagcccaatgagggtgacaacgactatatcatccccctgcctgaccccaaacccgaggttgctgacgagggcccactggagggttcccccagcctagccagctccaccctgaatgaagtcaacacctcctcaaccatctcctgtgacagccccctggagccccaggacgaaccagagccagagccccagcttgagctccaggtggagccggagccagagctggaacagttgccggattcggggtgccctgcgcctcgggcggaagcagaggatagcttcctgtagggggctggcccctaccctgccctgcctgaagctccccccctgccagcacccagcatctcctggcctggcctgaccgggcttcctgtcagccaggctgcccttatcagctgtccccttctggaagctttctgctcctgacgtgttgtgccccaaaccctggggctggcttaggaggcaagaaaactgcaggggccgtgaccagccctctgcctccagggaggccaactgactctgagccagggttcccccagggaactcagttttcccatatgtaagatgggaaagttaggcttgatgacccagaatctaggattctctccctggctgacaggtggggagaccgaatccctccctgggaagattcttggagttactgaggtggtaaattaacttttttctgttcagccagctacccctcaaggaatcatagctctctcctcgcacttttatccacccaggagctagggaagagaccctagcctccctggctgctggctgagctagggcctagccttgagcagtgttgcctcatccagaagaaagccagtctcctccctatgatgccagtccctgcgttccctggcccgagctggtctggggccattaggcagcctaattaatgctggaggctgagccaagtacaggacacccccagcctgcagcccttgcccagggcacttggagcacacgcagccatagcaagtgcctgtgtccctgtccttcaggcccatcagtcctggggctttttctttatcaccctcagtcttaatccatccaccagagtctagaaggccagacgggccccgcatctgtgatgagaatgtaaatgtgccagtgtggagtggccacgtgtgtgtgccagtatatggccctggctctgcattggacctgctatgaggctttggaggaatccctcaccctctctgggcctcagtttccccttcaaaaaatgaataagtcggacttattaactctgagtgccttgccagcactaacattctagagtattccaggtggttgcacatttgtccagatgaagcaaggccatataccctaaacttccatcctgggggtcagctgggctcctgggagattccagatcacacatcacactctggggactcaggaaccatgccccttccccaggcccccagcaagtctcaagaacacagctgcacaggccttgacttagagtgacagccggtgtcctggaaagcccccagcagctgccccagggacatgggaagaccacgggacctctttcactacccacgatgacctccgggggtatcctgggcaaaagggacaaagagggcaaatgagatcacctcctgcagcccaccactccagcacctgtgccgaggtctgcgtcgaagacagaatggacagtgaggacagttatgtcttgtaaaagacaagaagcttcagatgggtaccccaagaaggatgtgagaggtgggcgctttggaggtttgcccctcacccaccagctgccccatccctgaggcagcgctccatgggggtatggttttgtcactgcccagacctagcagtgacatctcattgtccccagcccagtgggcattggaggtgccaggggagtcagggttgtagccaagacgcccccgcacggggagggttgggaagggggtgcaggaagctcaacccctctgggcaccaaccctgcattgcaggttggcaccttacttccctgggatccccagagttggtccaaggagggagagtgggttctcaatacggtaccaaagatataatcacctaggtttacaaatatttttaggactcacgttaactcacatttatacagcagaaatgctattttgtatgctgttaagtttttctatctgtgtacttttttttaagggaaagattttaatattaaacctggtgcttctcactcacagactttgtggtctctctcgggtttgggttcctgcccatagggagtgtggagtggggcacatgaggctcacccagacgcagacccccagacaggtcccttcagctctgagtctcattcattcatctgtaaagtggggattttcgctctcccacccctcgctggaagctggggggcctagacttgggcttggtttcccaaggtgggaagcgagcaggcttttctggctccacagagcctggccttgagtcgggcaggagggtgtggggctgcagggctgctccaaggctctggtgctgaggcgtctcactgcctccaccatgtgctttggctttggctatcagctgggacaccctcccctccactccgcccacaggcccggattgaggccggcgtgctctgtgacaggcagctgctagagcccagattccaggtccaggtgagtcatgatcaggccccaggtaggagaagggcagacagagtgtccaaaagcgtgagagcacgaagtgaggagaaggtggagaagagagaagaggaagaggaagaggaagagaggaagcggagggaactgcggccaggctaaaaggggaagaagaggatcagcccaaggaggaggaagaggaaaacaagacaaacagccagtgcagaggagaggaacgtgtgtccagtgtcccgatccctgcggagctagtagctgagagctctgtgccctgggcaccttgcagccctgcacctgcctgccacttccccaccgaggccatgggcccaggagttctgctgctcctgctggtggccacagcttggcatggtcagggaatcccagtgatagagcccagtgtccccgagctggtcgtgaagccaggagcaacggtgaccttgcgatgtgtgggcaatggcagcgtggaatgggatggccccccatcacctcactggaccctgtactctgatggctccagcagcatcctcagcaccaacaacgctaccttccaaaacacggggacctatcgctgcactgagcctggagaccccctgggaggcagcgccgccatccacctctatgtcaaagaccctgcccggccctggaacgtgctagcacaggaggtggtcgtgttcgaggaccaggacgcactactgccctgtctgctcacagacccggtgctggaagcaggcgtctcgctggtgcgtgtgcgtggccggcccctcatgcgccacaccaactactccttctcgccctggcatggcttcaccatccacagggccaagttcattcagagccaggactatcaatgcagtgccctgatgggtggcaggaaggtgatgtccatcagcatccggctgaaagtgcagaaagtcatcccagggcccccagccttgacactggtgcctgcagagctggtgcggattcgaggggaggctgcccagatcgtgtgctcagccagcagcgttgatgttaactttgatgtcttcctccaacacaacaacactaagctcgcaatccctcaacaatctgactttcataataaccgttaccaaaaagtcctgaccctcaacctcgatcaagtagatttccaacatgccggcaactactcctgcgtggccagcaacgtgcagggcaagcactccacctccatgttcttccgggtggtagagagtgcctacttgaacttgagctctgagcagaacctcatccaggaggtgaccgtgggggaggggctcaacctcaaagtcatggtggaggcctacccaggcctgcaaggttttaactggacctacctgggacccttttctgaccaccagcctgagcccaagcttgctaatgctaccaccaaggacacatacaggcacaccttcaccctctctctgccccgcctgaagccctctgaggctggccgctactccttcctggccagaaacccaggaggctggagagctctgacgtttgagctcacccttcgataccccccagaggtaagcgtcatatggacattcatcaacggctctggcacccttttgtgtgctgcctctgggtacccccagcccaacgtgacatggctgcagtgcagtggccacactgataggtgtgatgaggcccaagtgctgcaggtctgggatgacccataccctgaggtcctgagccaggagcccttccacaaggtgacggtgcagagcctgctgactgttgagaccttagagcacaaccaaacctacgagtgcagggcccacaacagcgtggggagtggctcctgggccttcatacccatctctgcaggagcccacacgcatcccccggatgagttcctcttcacaccagtggtggtcgcctgcatgtccatcatggccttgctgctgctgctgctcctgctgctattgtacaagtataagcagaagcccaagtaccaggtccgctggaagatcatcgagagctatgagggcaacagttatactttcatcgaccccacgcagctgccttacaacgagaagtgggagttcccccggaacaacctgcagtttggtaagaccctcggagctggagcctttgggaaggtggtggaggccacggcctttggtctgggcaaggaggatgctgtcctgaaggtggctgtgaagatgctgaagtccacggcccatgctgatgagaaggaggccctcatgtccgagctgaagatcatgagccacctgggccagcacgagaacatcgtcaaccttctgggagcctgtacccatggaggccctgtactggtcatcacggagtactgttgctatggcgacctgctcaactttctgcgaaggaaggctgaggccatgctgggacccagcctgagccccggccaggaccccgagggaggcgtcgactataagaacatccacctcgagaagaaatatgtccgcagggacagtggcttctccagccagggtgtggacacctatgtggagatgaggcctgtctccacttcttcaaatgactccttctctgagcaagacctggacaaggaggatggacggcccctggagctccgggacctgcttcacttctccagccaagtagcccagggcatggccttcctcgcttccaagaattgcatccaccgggacgtggcagcgcgtaacgtgctgttgaccaatggtcatgtggccaagattggggacttcgggctggctagggacatcatgaatgactccaactacattgtcaagggcaatgcccgcctgcctgtgaagtggatggccccagagagcatctttgactgtgtctacacggttcagagcgacgtctggtcctatggcatcctcctctgggagatcttctcacttgggctgaatccctaccctggcatcctggtgaacagcaagttctataaactggtgaaggatggataccaaatggcccagcctgcatttgccccaaagaatatatacagcatcatgcaggcctgctgggccttggagcccacccacagacccaccttccagcagatctgctccttccttcaggagcaggcccaagaggacaggagagagcgggactataccaatctgccgagcagcagcagaagcggtggcagcggcagcagcagcagtgagctggaggaggagagctctagtgagcacctgacctgctgcgagcaaggggatatcgcccagcccttgctgcagcccaacaactatcagttctgctgaggagttgacgacagggagtaccactctcccctcctccaaacttcaactcctccatggatggggcgacacggggagaacatacaaactctgccttcggtcatttcactcaacagctcggcccagctctgaaacttgggaaggtgagggattcaggggaggtcagaggatcccacttcctgagcatgggccatcactgccagtcaggggctgggggctgagccctcaccccccgcctcccctactgttctcatggtgttggcctcgtgtttgctatgccaactagtagaaccttctttcctaatccccttatcttcatggaaatggactgactttatgcctatgaagtccccaggagctacactgatactgagaaaaccaggctctttggggctagacagactggcagagagtgagatctccctctctgagaggagcagcagatgctcacagaccacactcagctcaggccccttggagcaggatggctcctctaagaatctcacaggacctcttagtctctgccctatacgccgccttcactccacagcctcacccctcccacccccatactggtactgctgtaatgagccaagtggcagctaaaagttgggggtgttctgcccagtcccgtcattctgggctagaaggcaggggaccttggcatgtggctggccacaccaagcaggaagcacaaactcccccaagctgactcatcctaactaacagtcacgccgtgggatgtctctgtccacattaaactaacagcattaatgca

SEQ ID NO: 403700 - DNA, 472 bp, Homo sapiens
ggtttcggatcctctttcgcttctctatctcgagaaacttgaaactgcgtcctctaggattgcatcaaactgcatcttgagcgtggaggaggactgctgagccccacgggttcgccgggctggagaggtcttgcgcaacctgagggttggggagagaggggtgttagcggagggaatgggccctgacggccctagaagcttccccgagcgcctcccacctccagcggacttgctgttaaaaacgcaattaatgcgtcctgtgagtcagaataaggatgactacttatggaagaggaaggagtgactggggtggggcgcgtggagagacttctgctgtggctggcaaagttctttttcttggtctcggaggcagttcactttgtagtaattagttaagccgtacatcagaaccattggattctgtatccgggttttatttttacaataaaaatacgtttaaaataatcagtta

SEQ ID NO: 403701 - DNA, 371 bp, Homo sapiens
caggttggaatgcagggaaacactttcacgtaaggagcaggtggaggagaagccaggtgaggagatgagaaatgatgaagcaaaggaggctgggcaccgtggcttactcctgtaatcctagcactttgggaggccaaggcaggcagatctcttgagcccaggggtttgagaccagcctgggcaacacggcaaaaccccatctctacaaaataatacaaaaattagtcaggcttggtggtatgcgcctgtagtcccaactactcaagaggctgagataggaggatcacttgagcctgggaggtcaaggctgcagtgagctatgatcgtgccactgcattccagcctgggtgatacagcaagaacctgtctca

SEQ ID NO: 403702 - DNA, 379 bp, Homo sapiens
aaaagtaagatattctgaaagagagcctatcccagaagccatgagacctgggcctgatctaagagggaagggaaacctgagattcctgtgaaccagctgggactagattttaaactagaagtcattctgatgtgcagctgagtttgagatctaataagttaaagatactaaaaagaagcaatcgaccaaatccagaatgtgaggcattttataaaacagaaggttcaagttcctcaacaaataaatggcatttttaccaaaaggagtgggagggaatgggaactgtcatagattagaagactgaacagacttatcaaataaatgcaaatggtgaaccatattcggaccccactgaaaacaacaactgtaaaaagactgt

SEQ ID NO: 403703 - DNA, 534 bp, Homo sapiens
atgtgatagacttcctcgattgagaacggattaaagcaagtccctaaaatttcatttcgtgacttgatgacccatctggaaaaacagacacacagtcactcactgaagcatcaaaaccttgctagtcccaggtgactgcaactgcctgcctggaaccctgctgttgtctgcctctaaaccaagcaggtgcctggcagtcaggacagaccatcagtggggctggaggagaggaccctggtttaataaactttacactctcaccttgctctggtaactgcagaaatagggttatgatttatatggtacattatggaaaaatcacattaacgggccaggtacatcatagggtctcagtaagtgttactttccttctgccactaactttggcaattttttgtggatatttggaggaggagagagggaaggaaggaaggtcagagatgggaagactcactttgctgttagtgaaatgggatcctgagtcgggtttcaggggccactgtgctatggttagaattactacttgggggaaaa

SEQ ID NO: 403704 - DNA, 446 bp, Homo sapiens
cccacacatcactgccgcccaactacagccaagcaaagcatctgcaatggctcaacagggtcaaccttaaagggcaaaatgctcttgttttcttgtttctcaggcaaagcttaattcactgggggcagtgcagggagaagaggggaggttcctttctgatgtcattggttctgacagtgtttcctgcccatcaacctttgtcatcaggctggatacagacaacagctgtatccattcatcatacttaggccactaatcacagagtgtgtgacaaaatgaccagggcctgccctagaagccagtcattgtctgtgaacatgcaccggctgactgattcaagcaatacctgtgtggataaagccacccggagcctcatctcacttagggatttttgttttgccatttgtttgttctgggtaaggattatgagggcactgttagtcaca

SEQ ID NO: 403705 - DNA, 394 bp, Homo sapiens
tgggattatagacgtgagccatcgtgtgcagccacttgggatgtctttattgtagagtaggtgtgaagaaatttaggtgtatctacaatgcttatataatatagctagatgtaatttttccattagtgagatgtttctttttaacagtattttagggaacatttttaaggccaagataaggagaaatacaataatacaaagttaactttgaaatggcgcacaattggtgatgactgtaataatttatagccatacagttggaacttcctgcccttttatgggctatatttttttggtaatgttttataatgttttataattatttgtaattaactgggacagataagcttactcaagtgtactctttcattctaggtggaaattactggtcttg

SEQ ID NO: 403706 - DNA, 213 bp, Homo sapiens
ttacacagatagaaggaaatatcagcttagggtgctagtttcactatttggtataaaagtgttgaaactggcctgtatgtaagcttcatagaaatctgaccgtttacatggagggaaacaagggaagaggacggttgcctcccccactcaaaggttggaattgtagtacagatactcgtggaaatcatcaatggtagtatttgggtaaagtct

SEQ ID NO: 403707 - DNA, 1485 bp, Homo sapiens
tactctactttgttatccaggagatgcaatacaaaacccattaattaaaacattaacagatactattaaaatactttgggataaggtcagaaatgctaaatgttacttattattttagacacattacctgatgcgaggcatatagtgcagatgattatggttagagttgtgattttctaaactcaaatacttctatatgtgaacatttttgggagatttttgtcacaactggagaaagattatttttaaattttagtaaactacttacaaaaactgaaccagacaaaaataattcaagaagctagaaatatgacaacatggtgcaataggaaatccttgaataaaaaatatatatatgtatatatacaccataaaatatagaatggtatattctgtatcattctatattccttttctaaagcatcattattattatttgagatgagggggagatctaaccatgttgcctgggctggtcttgaacccctgtcctcaagcaatcttccttcctcagcctcctgagtagttgggattacagacacataccactatgcccaccttaaagcttgcttgcttgcttgcttgcttttttttttttttttttttgagacaggatcttgctctgttgctcaggttggagtgaagtggcacgatctcagctcactgcaacactccagcctgagcaacagagcagactccatcttggggaaagaaagaaaaaaaaaaagaactatacatctaccaaaagcttcagttaaatgtttgggtatattgaaaacacactggatataaatttgaaaccactgttaaacgtgtgacaggaaaatcgagttgagactgccatgcccgtgtcaactgaccatgggttcttgggctctcaatgcaatagaacattgacatgaggccaaaagagttttctcaaagcttcactggagcttttgtccagccataagggaggcagaacgagagagaaagagagatagagagagacagagagagagagagagagagtattccctgacagactccacctataaaagaacaggtaggacttttttattaggcaaagtacagaactgacatcagaagtagagtgtacacaggctgggcaaggcaaacaatgtgaggggtagggtagcaggtcagcatatccagttgtgatggttatcttgagtaatgggccacctggtagtctggcctgtgacaacaagactataaatcaattgtccagcagcattcctttctgaggtgggacactctgcaaccttggttagctcctaaagccagttcctggaattctttaagtaaaaagactattagcagcgaggtaatggtgtgggttttgtgatgtgtgggaatgctctaatgggggtgaaccaaagccaggctctgtctctactgtgtctcaccagtaaaaacacaattacaaacagcatgcaatgctcttttttgtgatgatggttaataaagaatacacattctaaa

SEQ ID NO: 403708 - DNA, 515 bp, Homo sapiens
tctggccctgcagaggccaggcttgggctaccgagtcagtcacctcgtcctgcctggggagaggggatgcgccaccccaggaagcaaactccctggtctgtgctgaccggagccgacttcccgaggatctgctggttctaacctgggcttctccacctcagcactgctgacgtctggggctggatcattcttggttgtgggacctgcccctgtgcgttacaggatgtggagcagtgtacctgcctgccacccaccagacaccagtagcacccccaccccctcaagtaatgccaaccagatatgcctctggacattaccagagggtcctttgggtggcaaaattacccctggtggtgaatcacaaacattttcaccctggtgatttcactgacatgaagctggcaggggaaggtccccgatggccaggccacacccacccggtgccagcagcacaaagagaatgccctccgcgaacgtggggcacggaaaagcacctgcgatacgtcggcgatgaa

SEQ ID NO: 403709 - DNA, 2650 bp, Homo sapiens
  misc_feature (1012)..(1012): n is a, c, g, or t
  misc_feature (1014)..(1014): n is a, c, g, or t
tctcaataagtgtgtgtgctcagaggcagggagcgcaccatggcagatcccgggcctgtctgtgggagggagccctggcggagccaaggagagtgcagtgctcagatgagccatgacaagttggagctgctggatttaaaccacctacatcatcagtgggatttttattcctcgcattcagcaccttccaaaaaacaagtgacatttctaatattcaggtttcctcctctcccctttaaagttgtccatgtagaaatttcatatattaaggaactaagatttctttgataagcaaatgtttttcttcggaatgcgatttcatcactgtgtctaggggagggagtgttatttttagaaagggagggactaacgcttggtagttacagtaattagagagaattatactttagcagcaatgagattacttcatctgccttatatttgagagctaatttgtacaagtagctcctggggctgtgaagggcttgccaagagtaaaaggttcaaggagtgaaatagttaatgagattcgtgatagaaatgggaatatgattgtccacaaaagggaacatcttccttttggagggtgttttttagtatatcaactagtattgtttgcctttcagcctaaaatccttcctcttaaagattgtgcttgcttggctggatttttgctgatgctgtttaattttaagctcttttccacatggagctattccagctcatttttaaaaatttatttaatgcttccaaaaaatatcctgagttattactggcctttcttccttactgtatacccggtgcctggcaaaaagtaggtgctcaacaaagagaggaaggcagggaggggaaaggtgagcgagaatgagagggcgtcactcttcagacatttggggaatgcgatgataaggcctcagtaagatctgcctggattcaggtttctcatgtgtaattttttgacttttttcctcaccttaagcacgggctacaatcattagagattgtaccttcntncactttcctgattgttgttgacgaaataggccatttagaaaaacagttagctattgtggcagcgaaatagtttcattcctattggcaagtgtaaaatgaaccttttctgcatgtaagaaggatcctgctagagtttcgctcccaacactgctataggcctggcacaaaaatggaataaatataaagccctattcagaaaatatgttacatcacaggaactgtaaaatggggggattttttatacctcctttgttgttcctgagcaaattacatcatcatcaccaccaccattaataggtgacattaaagcacctacagtataccatgtacttcacaggtagtaactcattcagtcctcacagccaccttctgagttaggtgttattgttattcctactttgacagatgtgggaacagagcccctcctccccacacagccccttttatgtaacttgactaagatcaagcagttagtaaatggtagaaagaatatttgaatctacctagtgagtctctagtgcatgcttttgtccggtatcctggaaagcctcccacaaaaagctaatctttgccccattcaaaacatgcaccctgaagaagctgtttgtacaggattgggtttattctgttattaagacaaaggcatcatggcctttgggtgagaggcccgtgtgtgtttgggatttggcaatcagcattccatctctgtcatcaccattattgagaaaatagatggattggttccctctctgcagtcctgtggagcagttggactgctctctctgctctcaggatgatactgtgagaacaatttaaatatgctaagcacatgtcaggaaacagttttgtggtctttggacactcgctgtagccattccgttccatttcaggtgattttattcatttcatttgtagaataaaataaatccatttcacacacacacacacacacacacacacacacacacaccctctatacaccactaaagcctcccattaaacccatagaagacttaaagagctaaaagaggctataatataaaaaaaaaaaaagaaaaggactaaattgggttgacttcacaatggtttgctgtcctgccccttggccatgacttccatccagcatctactcttagaatcagagtgtatactctgaaacagaagcagctctccccaagctggctgtcttctgccaagtctggaggttgcagctctgaaagagggtggtaccaggggccaacgcctggtgcagcctcaggagcaacaggaccataggctcctgaggaaattgtccaagagagccagagcaccagtgttctctgcagtatgacttgggcatttgtttagtctggatttcctgtgtaatcagtgttttcctctgggactgtaatagaaccagtctactctccaagaggcctttagccaaagctcataatgataggactagctattaattgtctactactttctgtctactatactaaacattttacgtatgccatctaatttaacaagcctatctgctaggtactattaatccccttttgatagatgaagactttgagatttagagaggttaagccacttgccctggtcacgcagtgacaggatctgaatctgggcttcctctcttcct

SEQ ID NO: 403710 - DNA, 192 bp, Homo sapiens
tgctctgttttcatccctttagataactgtgacacctagaattttatgttaagtagagagtattcattgaaaatcaaggccaggtgcagtggctcacacctgtcaccccagcactttgggaggcagaggtgggcgtatcacttcaggccaggagtttgagaccagcctggccaaccgagcgaaaccccatct

SEQ ID NO: 403711 - DNA, 477 bp, Homo sapiens
gtggtggtgtttgtttttgtttcattttttatgagctaatattttaaaatgagagctcttacataaaaacacatggatttattgtttttcttgaaaggctggcaacattaaatctgtattcccactagggagaaattggctggagttgagaaaccactgccatctgcagttgggatattcattctccagttcctcatactcttcaccactcttttctcttacaagctcccgatataaatagagaaatcaattgtatggcccttgaagagaaagtgtgtgtgtgtttgtgtgtgtgtgtgagagagagagagacaggcgtgcatcagtagaaatgcagacacagaggaggagacatttgaactaagtcttgaagaatgatcaggatttcaagagatgaaagaaagaattcccggtggagggacaagtgtaagacagagcaccagagatagatagtgtgggcaatccaggcatagatta

SEQ ID NO: 403712 - DNA, 327 bp, Homo sapiens
atatcgtcgacccacgcgtccggaaatgtttaagacactccattgttcaatatttttgtgcatttgatattttatgcattttccacatgtaagaaatatttggattaacaggtcagtgtcctgttttcatacaatctaacatgtatgactaagcatacatgttcagtctaacatgtgtgactaagcacgtgataaaaaatttgcaattttaagttgaaatcttactgagtatgcaggcagtatcagcacatttaagagaacttaagaatttcttgacgatttttaaacttttttgtgagaatttcttaaatggagcggactagcata

SEQ ID NO: 403713 - DNA, 145 bp, Homo sapiens
tgagttaaatgattcaaggtttaagtgttgaaaataaaaattagcgattaaactatctgatgtcacaaagttattttaaaaattaatattgttttaaagctctaatcagagttttattcctgtgtgaaatagactcttaaaaaaa

SEQ ID NO: 403714 - DNA, 89 bp, Homo sapiens
tgaaaggcactcaaagtcagtaaagagagatttaaaagcaaaagcaaatgaagaaagtctgaaatgtaaaaactagaccaaactgtata

SEQ ID NO: 403715 - DNA, 376 bp, Homo sapiens
cccttcccactacaccaccaggcttcagcctccaaagagacaagtgcttggtacctacatgcaaagtgtgtgtgctggggggtgggagggctgcccagaacaggggagaggatggtgtaaaaaaagacctactcctttcctgttaccctctccccacatgtaccaaccttcctgttgctccctccatccacagaataatagctaccatttataaaatgtttactctgggctgggagcagtggctcacacctgtaatcccaacactttgagaggctgaggtgggatgatcacttgaggccaggagttcgagaccagcctgagcaacactgtgagacccccccgccatctctacataaataataaaaacttttaaaaa

SEQ ID NO: 403716 - DNA, 553 bp, Homo sapiens
ctaaatcaactgtgggctagaaactggctcttagactttatcttttatggtaacttacaccataatcaagagaaagctttttagttccaaggaattgtaattcagtaagatactctaaattcagtcatccatttctccctgttgccccaaaccactaggaagtaaagaaactgagcaaaagctgtatagctcttcattataatgctactgttttgttttgtttcatttattattattttttaatttgtcttttgtgttgcacatgacaggtgattgggtattttctttactaagtcttccatgtcactagagggttttaaaaataaagtgtggtggtgtttcttgataacagagttgagtatcaagtgcacgtgtctccctcgtatagggttaaatagtcatggtgagaatgtcttagaaatgatcagataaggccaggcgcggtggctcacgcttgtaatcccagcactttgggaggccgaggcaggtggatcatgaggtcaggagattgagaccatcctggcgctaacacggtgaaaccccatctctacta

SEQ ID NO: 403717 - DNA, 446 bp, Homo sapiens
tctatctgacattaataaacattccaagaagaatgtctgcaaagaggagagactgagaattactagccactcaattaggtcacttaacatcttatattagctgctcatttcatttgggagcaaggagaactgggttctcattcttcagccaatgagctggagaaacctggacaaataatttaattgcttgaggcttaattgtccaatcactgaaatgtaagaaaataagaaataatctttaaatttactttcaattaaataaaacactgattgttaatacatatttgaaaatatactagaaactgaacgtgcaaattaggataatgaattgcactctaaatttaaaatgcaagaaatgatgtattttatttcttatttatacatatatattatttcaagaattataaatctcaacatgctttccatataataaaaatgtttaatat

SEQ ID NO: 403718 - DNA, 675 bp, Homo sapiens
  misc_feature (62)..(62): n is a, c, g, or t
  misc_feature (98)..(98): n is a, c, g, or t
  misc_feature (118)..(118): n is a, c, g, or t
  misc_feature (125)..(125): n is a, c, g, or t
  misc_feature (132)..(133): n is a, c, g, or t
  misc_feature (145)..(145): n is a, c, g, or t
  misc_feature (160)..(160): n is a, c, g, or t
  misc_feature (186)..(186): n is a, c, g, or t
ttgagcccgtgcaatatttgatctccttcatcagcagtgcacaactcaagttgtcagcttcncagatgatctacaagcgctaacatctattgcatccntggtctggccatgcagattngtgtganttattcnnttagtaagaccnatatatcagctgtcntttaaagggctatcagtgtagagtcnatttttccactctgctgcattctcacttggaaaggttatggagtatattgtataattaaatatttgtagaaatgacccctgtcaagccttcctttaaagctatgatgtagttgatcttcagcaaaaatctggaattgaagaggtttgatcctgaaaataatagctgacttcaacatggtcatagtttcttccagtctttcacctagatacattttctcaacaggctgtattttcagactacacctgtcccacctgcggggatgagcagcgggacaagcgctgctcgcgcctctcaccgcaccgcatccgcctcccgccagccaggaagccactgcggcctgcggcttcccgccaccacggcccgctccttcctccggggacacggggagctggctgaaggcgtaaaggagcgagcagaagcctcaggccagacacagagccaccacgcgcggtagcgccgcatggccccagcggcgttcctcggtctcc

SEQ ID NO: 403719 - DNA, 575 bp, Homo sapiens
cagtggctcatgcctgtaatccttgaactttggtaggtcaaggtgggtggatagcctgagcccaggagttcaagccccacctggacaacacagacagatcccatctctacaaattttttttttaaacattagctggttatggtggcacgcgcttgttgtcccagctacttaggaggttgagatgggaggattgcttgagcccaggaggtggtggctgcagcgagctgtgatcacaccactacactccagctcgtgcaacagagcaagactcggtctcaaaaaaagaaagagagaattgaaagacagaggaagaaagaaggaagagaagaggaaagaaagggcaaaactgggattcaaacccaggctgtctgagttccgtatctagtctgtgcctaaccagtcaacccccctgcaaatgacagctgtacactgaacaaaatacaaaaaaacagcttcctgagggttcagctgaatgcagttagtccctcccttcccccacaactttttctctctggtttgccctcaggatggcagccatagcccagggcggcagcagcaggccaggggtcaggggt

SEQ ID NO: 403720 - DNA, 695 bp, Homo sapiens
gcaccacgctgacaataagtgggcgtttctttgatcagacagatttccccgtcagagttctagttggaggtgaaccttgtgatattttgaatgtcacagaaaatagtatatgttgcaagacaccccccaaacctcatattctcaaaactgtatatccaggagggagaggcctgaagcttgaggtgtggaataatagccgtccaatacgtttggaagagatactggaatacaatgaaaaaacgcctgggtacatgggtgccagttgggtagattcagcttcctatatttggctcatggaacaagacacatttgttgcacgctttagtggatttttggtggctccagattctgatgtttatagattctacatcaagggtgatgaccgttatgctatttattttagccagactggacttccagaagataaggtgaggattgcatatcattctgctaatgccaacagttatttttccagtccaacacaaagatcagatgatattcatctgcagaaaggaaaagaatactatattgaaatcttgctgcaggagtacagattaagtgcatttgttgatgttggactgtaccagtatcgaaatgtttatactgaacaacaaacaggagatgcagtgaatgaagaacaagttatcaaatcccagtcgacaatcctccaggaagtacaggtttgctatgattgc

SEQ ID NO: 403721 - DNA, 562 bp, Homo sapiens
ataagatgccatggaagggatggcaataagcgttttccataaacaacccgagagagagaaacagaaaacgctgtccaagctaagccttgcttccacactgggctttgcagattttccaatgagccaccaacgaggtggttaaaacatcagagactgcatccgattccccaagacaccaaggctctcgggatgggaacaggcaaatcgtcgtcgttctttgctgagcctgcgggctgcggtcaccagaacgaatctgggcccagcaggtgccaagggctcgacctcccgccttgcatccggcaggccgcacacacccctcggaagtcggcgagatcgctgaggcaaagcgactccagggcgcagagacccacacgcgacgctctaaaggaagtgacctttaggggctgttactctcagaccaggcccagcagcacccggcgcatttacgtcggatctgacccctgcaagcaccggcgcgaccgcgctagcggctgggaacacgcgacggtcccgcccactgcgacctgactcggccaatcccgggtggcgcatgctgcggccg

SEQ ID NO: 403722 - DNA, 387 bp, Homo sapiens
cattgcattacaacattatgatggctacagcgtcactagaggataggaatttttcagctacgttttattatcttatgggaccacagtgatatatgtggtctgtcattgactgaaacgtcattatgtggtgcctgactacatatatggaaactctgagtgtagtcatgttttacaaatgagtttatcttgcagtgagtttaaatatcaagtaaaaatactaatttcattgtaatgtatgaagagattggcctttctcctcatgttgaaggtatcaaaacaaaatagaaaatatttggcttcctgagtggcatggctacaattcacatgctgagttggtgatgaggcaagatcccttgactttgcaataccagaaaaatgcacatagtt

SEQ ID NO: 403723 - DNA, 460 bp, Homo sapiens
ctactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaaatagtacccggttcaatgaaagagcctaaaccatcttaactcagctttaaaacaaaaattaaatcaggaaaaaatgaaaaaaaaactgcatgaa

SEQ ID NO: 403724 - DNA, 144 bp, Homo sapiens
aggtgaatatgcttagcatatggtaaggtactcaggtcttagttttatttcttcattatttattacatagctctttcctcttaaattctattaagacttagttctttttcactccccttttaagaaaagcaaacgggaatcttt

SEQ ID NO: 403725 - DNA, 409 bp, Homo sapiens
tgccttaattttatttttagagtttgggagataccctggccctatgagcatcccaatgttaaataatctcattcattatgttgtgatttctgctacaggatgatcttttaaatcttaatttctttctgggtgtggtggctcacgcctgtaatcccagcacattgggaggccgaggtgggtgggtcacttgaggtctggagtttgataccagcctggccaacatagcaaaaccccgtgtctactaaaaatacaaaaattagccaggcgtggtggtgtgtgcctgtaatcccagctgctcaggaggttgaggcacaagaattgcttgaacccaggaggcggaggttccagtgagctgagattgtgccactgcactccagcctgagcaacagagtgaaactgtttcacaaaa

SEQ ID NO: 403726 - DNA, 375 bp, Homo sapiens
cagcccataaggggaagggcattattaacaacatcttgaagataagaaacctgggcttccatcctagtttcttcttcaataaaacaaacaaaacgggctgggcacagtggctcacgcctgtaatcccagcacttttggaggccgaggtgggcggatcatgatatcaagagatcgagaccatcctggccaacatggtgaaaccccgtctctactaaaaatgtgaaaaaattagcttgatgtggtggtgcgcgcctgtagtcccagctactcaggaggctgaggcaggagaatcgcttgaacctgggaggcggaggttacagtgagctgggaccacgccactgcactccagcctgatgacagagcgagactccatct

SEQ ID NO: 403727 - DNA, 876 bp, Homo sapiens
gcatggtgttttaccgtggtaggggatggggaaacaggagctgagagaagaggtcttcgattggaggtgagccaacctctattttattagggtggtggtgggcaggggagcaagcaccttgggagcagctctacccactgcttgccctcttgcaggaaggtcctagtgggtgactggaagtaggatagggatggggagttgggtgtggctggaaaaagcgatgacaccagctctgagccatgaagcatctttctaattccaagatggagctggatggggtggggtagggtggagcagagcaggggccttccggtccagtgcccctcacccttccttcttcccaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403728 - DNA, 498 bp, Homo sapiens
  misc_feature (59)..(59): n is a, c, g, or t
gacgagagtgactgtggagacttcccgaatgggtccctgggggatgactttgatgccancgacgaacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403729 - DNA, 300 bp, Homo sapiens
  misc_feature (42)..(43): n is a, c, g, or t
tctgaggatcctttagactgcgagaagagactgtgcgagtgnntgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccgggccgccccggttccttctcttctttcatctccct

SEQ ID NO: 403730 - DNA, 2293 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403731 - DNA, 2439 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403732 - DNA, 2213 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403733 - DNA, 2207 bp, Homo sapiens
  misc_feature (42)..(43): n is a, c, g, or t
tctgaggatcctttagactgcgagaagagactgtgcgagtgnntgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403734 - DNA, 2962 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaacaaaaaaaaaaaaaaaaaaaaaaaaaaaaaaaaaaacacaaaaaaaaacaagaaaaaagagaggggcggcgcgcgcgcgcgagaaaaaccccacccagcgagggggggcgcacacaagacgcgcaccagccgaccacggagtgcgaacaaaagggcggcgcccacacacgcaggagtcgagttgctactatataataccaacgagtagcagccgcgcgcgcgggcggggagcgagactaaacaacacgagcgagggggcggtgcgagcacaaacaactcgcgacagcagcgcgagcagccctacggagggagagagagagcgacacaaccaactgatgaggcgggcgggggggggggacaacaaagcgggagcaacacaaccccctcccaccacaagacaaggagagagaataagacaccgcccgagacggggaaggcacaaaacaaccacaaggcagcagaagagcggagaaggggggcggtaacagaaacaaaaggaagcggggaaagaaggaacgcgcggcggggaggagaaagaaaagacaggcagcaagcgacggggagggcagcgcgatcgtggcagaagaaaaaagaaatctcgcagcagcgcgagggggcgaggggcgatacgagcccaggggggggggg

SEQ ID NO: 403735 - DNA, 2047 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgtgaggcgcggggagcggcagggcggccccacggggagggggcgcggggcgccgggagggggcgagtgggggtcaccaaggggagctgggaccgcctggggctcctgagcccggctccgcgctgcgtaacccggcgacccaccccagcagcccggcccggccatggcggccccccgcccgtctcccgcgatctccgtttcggtctcggctccggctttttacgcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403736 - DNA, 2242 bp, Homo sapiens
  misc_feature (1124)..(1124): n is a, c, g, or t
  misc_feature (1143)..(1143): n is a, c, g, or t
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggtcagaaccaaaancaggtgcgctccctggggncccaggtcccctgactctgaaggaggtggaggagctggagcagtgaccagcagctatgcaggacatggagcatctcagaggcgatgtggctgtcaacgaactctgcggacgatgccatcaaccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403737 - DNA, 2025 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagctcccccatgctgccaagttgtagctatagctacaaataaaaaaaaaccttgttttccag

SEQ ID NO: 403738 - DNA, 1002 bp, Homo sapiens
cccacgcgtccgcggaccgcgtgggcctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403739 - DNA, 1162 bp, Homo sapiens
cgcagctctacatacttccttctatttactgctgtcttctctggccttcccagaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgtgagtcgggctgtgctgggctgtgctgggctgtgctgggcagtcgggccctggaagcttgctgtggggtgccggttccctgccaacctcctcctgctgcctcctcagacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403740 - DNA, 1735 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccagggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403741 - DNA, 604 bp, Homo sapiens
  misc_feature (22)..(22): n is a, c, g, or t
  misc_feature (32)..(32): n is a, c, g, or t
gtccagggctgttacggtcccnaagtcgtttnattggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403742 - DNA, 1731 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaacaaaaaaaaaaaaaaaaaaaaaaaaaaaaaaaaaaacacaaaaaaaaacaagaaaaaagagaggggcggcgcgcgcgcgcgagaaaaaccccacccagcgagggggggcgcacacaagacgcgcaccagccgaccacggagtgcgaacaaaagggcggcgcccacacacgcaggagtcgagttgctactatataataccaacgagtagcagccgcgcgcgcgggcggggagcgagactaaacaacacgagcgagggggcggtgcgagcacaaacaactcgcgacagcagcgcgagcagccctacggagggagagagagagcgacacaaccaactgatgaggcgggcgggggggggggacaacaaagcgggagcaacacaaccccctcccaccacaagacaaggagagagaataagacaccgcccgagacggggaaggcacaaaacaaccacaaggcagcagaagagcggagaaggggggcggtaacagaaacaaaaggaagcggggaaagaaggaacgcgcggcggggaggagaaagaaaagacaggcagcaagcgacggggagggcagcgcgatcgtggcagaagaaaaaagaaatctcgcagcagcgcgagggggcgaggggcgatacgagcccaggggggggggg

SEQ ID NO: 403743 - DNA, 1294 bp, Homo sapiens
  misc_feature (1268)..(1268): n is a, c, g, or t
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacctcccagcttcactatgcccagcagagggagaagccccgagtgcaggagaagcagcacccgtgccccctggagggcacctccttcatcgtggaccaggccaaccggccccactgtgtccccgactaccacaagcagtacgccccgaggtgctccgtctgctctgagcccatcatgctgagctggcgaangagacgtccatggcccctgacagacc

SEQ ID NO: 403744 - DNA, 976 bp, Homo sapiens
ggctggtacgctcggagtacgggatcaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaacaaaaaaaaaaaaaaaaaaaaaaaaaaaaaaaaaaacacaaaaaaaaacaagaaaaaagagaggggcggcgcgcgcgcgcgagaaaaaccccacccagcgagggggggcgcacacaagacgcgcaccagccgaccacggagtgcgaacaaaagggcggcgcccacacacgcaggagtcgagttgctactatataataccaacgagtagcagccgcgcgcgcgggcggggagcgagactaaacaacacgagcgagggggcggtgcgagcacaaacaactcgcgacagcagcgcgagcagccctacggagggagagagagagcgacacaaccaactgatgaggcgggcgggggggggggacaacaaagcgggagcaacacaaccccctcccaccacaagacaaggagagagaataagacaccgcccgagacggggaaggcacaaaacaaccacaaggcagcagaagagcggagaaggggggcggtaacagaaacaaaaggaagcggggaaagaaggaacgcgcggcggggaggagaaagaaaagacaggcagcaagcgacggggagggcagcgcgatcgtggcagaagaaaaaagaaatctcgcagcagcgcgagggggcgaggggcgatacgagcccaggggggggggg

SEQ ID NO: 403745 - DNA, 661 bp, Homo sapiens
  misc_feature (83)..(83): n is a, c, g, or t
ccatcgatgattactcacgtgcgttcctcggttttaatttcgtacgggggtgtcgttcccttctcggttagtggcctgttgcntgacagtgacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgtcctccggaagactttctcccttgtcgtccatccttccctcgttgctggagtgactggctgagcagagtgacgagatgtggtgactctgagtggaggggtgtcgcatttcctcgtcatgacgcacttctgcgcctaaactacgtcaggagatatacctcaagcagcctcatgcacgtcattcttgcgcagcgtagtgcactagtcaatcccattatgcacactggttaaacagtcagcgcacaaaggaagggaagcgagtaccggcaccgtcaaaacagggctgatcaaa

SEQ ID NO: 403746 - DNA, 604 bp, Homo sapiens
tctagagatcccctcgaagaggaggtgttcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403747 - DNA, 954 bp, Homo sapiens
cacggaaatagtaggagtcggtcccgggtttaatttcatgacgggggtgtccgtttcccgtgtaggctagtagggcagttgctgcgaccagtgacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgacgacgacccgcggaaagattacgcctgcctggactctactgtgctggggatgcccgacgatgcagatggtgactcgtgcgagggattgcatgtctgcgcacgtaactatgcccgagggcacgtactacacttattggcaaggagatcattgaccctggatgttggaccgatattcgcaagctggctgaccagtgcaccggtcttcagggcttcttggtttttccacagcttctggtgggggaactggttctgggttcacctccctgtcatggcaacgtctctcaggttgattgatggccaagaagtccaagctggagttctccatttaccccagcaccccgaggtttgcacagctgatagctagagccctacaactccgatccttcaccacccagagcagcctggagcactctgattgtgccttcatgggcagaacaatgaggcccatgtactgacactcgtgtcgtcgcaacttcgcatttcgagcggcaaaccttaactaccttaatcgacttgattaggcacattgggctctcaacaaatgcttcccgacgattgaggaccccgaagggtcctgaag

SEQ ID NO: 403748 - DNA, 2318 bp, Homo sapiens
  misc_feature (83)..(83): n is a, c, g, or t
ccatcgatgattactcacgtgcgttcctcggttttaatttcgtacgggggtgtcgttcccttctcggttagtggcctgttgcntgacagtgacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403749 - DNA, 1991 bp, Homo sapiens
agctgcaccactcctcggcagtgcgcccggcctttcctgacctgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403750 - DNA, 2466 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaactcgagggggggccccggtacccaaaattctccctattagggagtcggaattacaatttacacttggcccggtcggttttacaaacctccgtgaacctgggaaaaaaccctgtgcgtttacccccaaactttaattggccctttggaaaacc

SEQ ID NO: 403751 - DNA, 2834 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaaaaaaaaaaaaaaaacacaaaaaaaaaaaagaaaaaaaaaaaaaaaaaaaaaaagggggggggccccaaaaaaaacccccggggggcgccaacaaagcgaccccagttttggagaaaaaaggggcgccccaaaaagagagacggacgataaataaaaaaaggaaacgaccagcggacgaggcagcgtagtaaaaaaaaacgggcagtagaaggagagaaaaacaactccacccgaggcagaaaacatctatggaaaaaaaacacccaaatcattgaggaggggagagaaaccatagtaggagggcaaaaaaaccatgacaaagaaaatatataagagacccactcgagagggaaataaataagagcaagatgtagagaggggataatctatgaggatgttaaacaacaaaagataaaaaaataatgcttacagggaaagaaaaaaagatagtgtgtcacaaggaggagtatattaatataggacaaaattaataacccgagaggatgatataatataaggt

SEQ ID NO: 403752 - DNA, 2284 bp, Homo sapiens
  misc_feature (1166)..(1166): n is a, c, g, or t
  misc_feature (1185)..(1185): n is a, c, g, or t
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggtcagaaccaaaancaggtgcgctccctggggncccaggtcccctgactctgaaggaggtggaggagctggagcagtgaccagcagctatgcaggacatggagcatctcagaggcgatgtggctgtcaacgaactctgcggacgatgccatcaaccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403753 - DNA, 1751 bp, Homo sapiens
  misc_feature (633)..(633): n is a, c, g, or t
  misc_feature (652)..(652): n is a, c, g, or t
cggacgcgtgggcgaccacgagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggtcagaaccaaaancaggtgcgctccctggggncccaggtcccctgactctgaaggaggtggaggagctggagcagtgaccagcagctatgcaggacatggagcatctcagaggcgatgtggctgtcaacgaactctgcggacgatgccatcaaccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403754 - DNA, 1451 bp, Homo sapiens
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403755 - DNA, 1785 bp, Homo sapiens
  misc_feature (1700)..(1700): n is a, c, g, or t
  misc_feature (1703)..(1703): n is a, c, g, or t
  misc_feature (1708)..(1708): n is a, c, g, or t
  misc_feature (1710)..(1710): n is a, c, g, or t
  misc_feature (1716)..(1716): n is a, c, g, or t
  misc_feature (1723)..(1723): n is a, c, g, or t
  misc_feature (1726)..(1726): n is a, c, g, or t
  misc_feature (1740)..(1740): n is a, c, g, or t
  misc_feature (1743)..(1743): n is a, c, g, or t
  misc_feature (1747)..(1747): n is a, c, g, or t
aaggctgtctggtctggaatttttgggatgtcctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagctggcgagatngantgggnantggcgnccggcanganttccctgatgtccntgngagntggggagccctgtcggtgagccttatcaggctctccca

SEQ ID NO: 403756 - DNA, 917 bp, Homo sapiens
acagtaagggtcgagtgggagagaacaccgtggcaggtgtgtgggaggctcccttgctttgggagagtgactggtgaggcaggaaattccctttgatgagggccagtcatggtgtctcactcttaggcccttctggtgagcttccttcacctggagatgcagggcagagaagtctgcttccttgctgcccaacctggcttatgcgtgcgcacaccggggatgaaagccctggctaactcggctggccctttctgccccttccaggcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccag

SEQ ID NO: 403757 - DNA, 1316 bp, Homo sapiens
  misc_feature (281)..(281): n is a, c, g, or t
aaggctgtctggtctggaatttttgggatgtcctccccgcccggctggaggctgctccggaccgggacgcagagtctgcggacccggcgccgaggcggccacccgccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaaaaaaaaaaaaaaaacacaaaaaaaaanaaaaaacaaaaaaaaaaaacaagagagggggcgcgccgccgcactgagataacattccgccgagagaacgccacccctgctcggccaccccgccgcagacattgattgatgacaaagagggcggcacccacacagcgagggcagccacattataattaacaccaggcgaggcgcccgacgctgtatctattacacaacactcgcagcgtcggtccggaagaggagagaaacagacatagcgctgcgctcacagctgagtgacctaacttatattgagcagacgaaaaccaaccacaatctatcttacgtgctgtgggtgcgagaacacaccttcgtcggtagcgagcacaccaaactcacccatacgagaaagtagatttatactcactgtccagcaggagggcgaaatataaactataacaattatcatagaacacgtctacaggtatcgctactcgcgatcgaacaaacactcaccacacccatccatacactaagatagatcagacccattgactccgcgccgacacaactcgacgataaacaactaagcccagagctgccatcatcaagtcagatgcgcgatatgaatcatgcttcatcaagacgagaacacaccaccacatctttatacacccacaccagcgagcgtcgtaccaatgataaaacaagacacacccacgcccgaccaccaagcgagcaagatggtgcaagaaacatatgcgaaactacagaaccagcatcacaaacgaaatcagaaatcagaacaatactccacagaagacagatcagaacaaggactgagcgtgattaagtcgagacacgacaaccatcacagtacaggctagagactacataacagtacacagatgataagaaggtgatcgatgacaagagcagaagatagacaaagactctcagattagacatacaaagtgagaaatagcaaaactaacggataacacgacaaatatccatctcatagctaacaaccaaccacactcaaaaaagaggatcatactaagacacgaacaa

SEQ ID NO: 403758 - DNA, 294 bp, Homo sapiens
cactgctggatgacatgaccaagaatgatcctttcaaagcccgggtaagggaccggagagtaggaaaagcagggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggtt

SEQ ID NO: 403759 - DNA, 491 bp, Homo sapiens
tgattaaacatcagtaactagagtcaacaatcactgtcctcccatgcctggcactctccactccccacccaactgcaatgtggccttgcttttcttatcagtaaaatgggagagctggatttgggggctggaagatatctcacagcttgaccatcctagtggaacggagggagaccagacagagagcagacgaccgacccaggcagcatccggctcagacacagacatatcttcatttcaagggacctattcttactcaaagaaaacccagagaagtcgattgctcagcctgagccggtcatccctaaatggagtcagcttttaggagaagaggaagagttcaggagacagcatcgctctttgtatcagtgtttgactagccaatcaagaaacgtttgctgaattcttcatgtcatacatgtctgtgagctctgcccttcgaggatgtctgttgtgaatgatgactcagtgattaccagcctttatcagaa

SEQ ID NO: 403760 - DNA, 369 bp, Homo sapiens
atgagacagagacactaatagttgtgattcctatgacataccgatacctgtgacctgccaactagaacactgccacctagtcataactacagcaaaagaataattgctatttgctccttttaattggcaatttatatgtagtaactgatttttttccataaactctaattttgatcaatcaaaatggtatattctattgccatagacaagtccacaagggcacaggcctccattcagtatactggccctttctgcaatagcatgcaaagatactagaaatgaagaatcccagaggtgaacacaggccacaccagcgtcggaaatgaagaagatggcagatgctgcgcagaccgcccgggaggaaagtat

SEQ ID NO: 403761 - DNA, 758 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaaccattggaaggattttgttagaaaatccgaaggggttcattggccctaaaaa

SEQ ID NO: 403762 - DNA, 1526 bp, Homo sapiens
actcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactggtaaaaatttctcactgtaataattgaagagtctgatattccaccatacttattttatggatgaagtaatatttgggataatataaaagacttgcatagatatgtatatcaaattaatagtttaactcggatgtgagcttttaatttcttatttagttattaagcatactgcctcctgaattaactgcttttcattttcttcaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacactggaacgatctcggataaggaattgcggatggttgcattgatctagaagagtatgacggggactcgtaccagacatgaagggcactacgatgagcccgaacgggtaaagacacagcaagagagagggagtgacgagataagaaccgggagggcaaacgcaccgagacaacgacgcaggactcacccgcaccagacagggagggcaacacaggaccgggctgtgactcgaccaagaaagaggaagccaaggggagaggacaatgaataacgggcagcggcacaacagcgcgaaacaacacgcacgcacagaccccaccaaaa

SEQ ID NO: 403763 - DNA, 3433 bp, Homo sapiens
  misc_feature (3418)..(3418): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaaaaaacaacaaaaaaaaaaaaaaagggggggggaaaaaaanccccgggggggccaa

SEQ ID NO: 403764 - DNA, 4068 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcattatggggtatgtatgaccttcattttccaagaaatagaactctagcttagaattatggatgctctaaaatgtcagaatgggaactctcctcgaagttctcccaaactcagagacagcactgccttctcctaaatgattattcttttctccctgttttctggtattttctagcatccttctcaccacagccataacccttttttacttccattaggccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattttgagaacctcgagagaattaaactattaactttagtaaacacacagtttaagacaaatataaaggtttagccaaatgcaacggggaggaagcacctggaataatttgtgcttgctcaggggcttgtggacatggctgttcctgccaaagctgtagcagttatccaaaagttctttcaaactcatatttggggccactgagtttttttttttttgttttttctttatgtctctcccatttctaaagtgttttcttaagtttgttctaattcagcatatatcatctcagaatggatccccagcaggaaaaaaaaaa

SEQ ID NO: 403765 - DNA, 3374 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403766 - DNA, 3236 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgcc

SEQ ID NO: 403767 - DNA, 3870 bp, Homo sapiens
actcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactggtaaaaatttctcactgtaataattgaagagtctgatattccaccatacttattttatggatgaagtaatatttgggataatataaaagacttgcatagatatgtatatcaaattaatagtttaactcggatgtgagcttttaatttcttatttagttattaagcatactgcctcctgaattaactgcttttcattttcttcaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403768 - DNA, 4648 bp, Homo sapiens
ccttatgtctatgtagatagaagaggatatttaagagataactacttttttttctgagacgaagtcttgctctgtcacctgggctggagtgcagtggcgcgatctcaactcattgcaaccgccgcctcccaggttcaagagattctcctgcctcagcctcctgaatagctgagattacaggcatgcgccaccatgcccggctaatttttgtgtttttagtagagactgggtttcaccatgttggccaggctggtctcgaattcctcacctcccgccaggtgatctgcccgcctcggcctcccaaagtgctgagattataggcgtgagccaccgtaccaggccagagataacttcttactggtttacctttcctgttaacattttagagcaagattacacattctctgaaggaaaatgctagttacttacaggatttaagtaatagttgtatctaacacctgatctgtatcaaaatgagtctcttttcttagagtcactagtacttttcaattctgatcactttcctatgttgtattcatgaaatgaacacaagctggggaaagacattatttgctaccaagtgacaatcttttcaatcctgcaaataatagagcataggactataccaagatttctcttctgttggaagttttgacttcaacttcatattccaaactgggctgcttacttgggtgacattacataggatgactttgcccctatagttaagtgattgcacctttaaacagaagttttcatatcatggacatatttttaaatccataagatgacagatctggaagaaagacacttataaagcttcataaagccactgattctttagctttgtggttttgctttataatctacatactaaccctttcagcttattaacattcttataatcagatatacattcttaccacatcatttcctcagagttctctgttttcatgtaaaaatccaattcaacacagtatttaaaagctgctagccattttttagacaagcatcttcctgtctttttatctgttttttaaaaataatcttgccttgagatataaatgatcccagaacttttctgatatctttgtatttttatcaaaagtgttactttttctaaaatcagctaaatttttgaagtctgatgtaactattttgaatttttagaaaaccatgattatttaccaagaattggagtttctcttctgtaagcaataaagaaaaataaagttcagccacatcttcactagagaaaataaaaatgaaaacaaggaaaaacaaagttttacatgttgtttgatgcaaagagtggagaacttggataggaatggatattcactcctgaattctaaccataggctgaaatctacctccaaagagataggctgagtttgcttttggatccaagtgcaccagccatgactgtgttgaccttattcacgtggcttattacagaccagtaatggaccatttttttcagttgctggcctggcagttttgttttggagacaattttttatttctgtgcattagccctgggcacacacctggctaagtccagagttctgtgtctttttaaccttttgctggatttctctgcattttctacagaaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403769 - DNA, 3369 bp, Homo sapiens
gggtgcggtgaacggcggtgagagaatgtgatgccctcgtgggggcttcgatgaccagtatcctcaacttatcatagtacctgataacaggaatgaaatgttgcctgattccctgtgtcaccagaccgtgtacgacctgtgcaggccatatccgcacagtagagacagaaggactcgatgctatcagtacactagagtgcgtcgacgctgcagctcgagcaatggctatcactaagatggctcctattttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403770 - DNA, 1461 bp, Homo sapiens
  misc_feature (69)..(69): n is a, c, g, or t
cagtccttatcaaagagagatgtggaaagagctaaagaaaccaccctttgttcccaactccactttacncatattttaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403771 - DNA, 2552 bp, Homo sapiens
  misc_feature (2031)..(2031): n is a, c, g, or t
  misc_feature (2039)..(2039): n is a, c, g, or t
  misc_feature (2042)..(2042): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaanaaaaaaanaanaaaaaaaaaaaaaaaaaaaaaaaaaaaaaaaaaaaaagaaaaaaaaaaaacaacaaaaaaaaaaaaaaaaaaaggaaaacacaaacaaacacagcaaagataaacaaagaaaagatacacaaagcaagagaaaatacgaaagaagcaatacacagcaccatcacaacgacaaaaagggggggggccgcgacccagcacacgcggcaggagcgaggaaagcacagccccccggcagcacactagagagcaccagcgacagccagaaggtgcgaagtgacgacaaaaaagacggcgcgacggggggagcaaccacaacgaacagcggctggagggacacgacgatcgtagctcgtatgccgacggaggcaacacacatgctgggggggcagacactagccgagcacaccacagcacaaaacactcggtacgggaagaaacacccagaggcaaggtgcggagcgaagacgccacaggccggggaacgcgacgacgagcgagagaaaaaaaaag

SEQ ID NO: 403772 - DNA, 1663 bp, Homo sapiens
actcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactggtaaaaatttctcactgtaataattgaagagtctgatattccaccatacttattttatggatgaagtaatatttgggataatataaaagacttgcatagatatgtatatcaaattaatagtttaactcggatgtgagcttttaatttcttatttagttattaagcatactgcctcctgaattaactgcttttcattttcttcaagatctaattatcatggacctgcgacagtttcttatgtgcctgtccctgtgcacagcctttgccttgagcaaacccacagaaaagaaggaccgaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403773 - DNA, 1576 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagccgtataactggagagacctgctgctcgttatataattatctgataccaaacacaagcgattctgaatgtacacacacgtttatctatagagcataaggtaaaacaattttgtttaacattttggtattgtttacaaatgttattaaaacatgcaaattcattttgagaacctcgagagaattaaactattaactttagtaaacacacagtttaagacaaatataaaggtttagccaaatgcaacggggaggaagcacctggaataatttgtgcttgctcaggggcttgtggacatggctgttcctgccaaagctgtagcagttatccaaaagttctttcaaactcatatttggggccactgagtttttttttttttgttttttctttatgtctctcccatttctaaagtgttttcttaagtttgttctaattcagcatatatcatctcagaatggatccccagcaggaaaaaaaaaa

SEQ ID NO: 403774 - DNA, 3015 bp, Homo sapiens
  misc_feature (2102)..(2102): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctgggtaaggggcaagatgtcagcctggcagggaccgtggtcttgagtcaaagaaacaaatgggtcacacagtaaaggaaaggaagcttatcttaaatagttcaattcagtgctaagctgattccctttattaattttaaatttgtatattatgtatttttaaatttgtttaatttttgttttctgaagtctggaagtctggtatcttctacatttttagcattttacatatattttaccattttttctttatgtcatccctcatagagacaatttttggagtagatttcatttaaaagaatacattgggctgggtgccgatagctcacgcctataagcactttgggatgctgaggcaggaggattgcctgggcccaggagtttgagaccaatctgggcaacatagggacaccctgtctctaccaaaaaaaaaaaaaaaaatttaaattagccaagcatggtggcacacacctgtcctagatactcaggaggctaaggtgggaggatcacttaagcccaggaggttgaggcagctgcgagccatgattgcactgctgcacaccagccttggggacagagcgagctctgtccaaaaaaaaaaaaaaaaaaaaaagaggctatgaggctacatacttccaacagtgcaaagcaaggggctttgagatgtttcttgacatggtcccagtaaagtgttggacctaaaattcaaaccaaattagatttctttataactggtgagaagtcttaataaaatagttttccttaataaaatttaactatttcagtatgtctgcttactgaagtttggaaatgaaaatttcccatttgttttctctggcacatgagtttatcagcctgctttgcaagtgctttaaggcaaataaatgttaatttgattgctttttgttgatttgatagcttgtatgcttgggccacctgttagtaattttcttttacttgtaacacttgcctgctgctgaatactaggcagtgagtcttattgagttgatgatccagggtgtttttatttgtgaaattcctctgttgtacatggttacagtttaagacaagaattgtattaatataaatgaatataaatggtactttctccattttaatcctggaaattaggcaaccttctgggttaaagcaagcgttctccgccactgactaacagtgagtgtataatggatctgtttccccacagatagccagctgtctgcattaattacaggactgcatgcatttctggtgaagagacttttatttctgtgtcaggcttgttctcattcctaagactaaagtggcactctctctcaatgcttgacacttagccaagaaccaaacatatccttcacccaattaagaacacatgtattaaacagtcagcacagatggagaggcatcctgcttcttgctctggctgagacccaacaccttcctgatttatttggaattaatgataaatacaaagcaaagagtaggctattggtgatctaaacaaaatggtgtgtaaataaatctcagctccgacctaggcactcacttgctgcccagaatgattcttcggngctgtgtatgattatgtgcataaaaatctgttgagagctctgttgcctcacaaggcagatgattcaacgtaatgggtatttctgctgcctgagactgcataagctgaagcactggctgggaagcaatgtctttataaggcatctttccccagaggcatgagggtggacagcactgagggggtcatgagtcggcttagagaagtgaggagtttttgttactgtgtgttcttgattcaatttggagttcaggtataaatcatcatagctcttagttaaaatctgtctcaatgaatccgctatccatgagagaaaggttaacactgtctctgccacaaggaaaatatgaaatactgagatctaccctgcctatagcaaaactagatcaagagcctacctaaagctgtatacaggccagctagggccaaaactggtgcttaggataaatacagcattccaagcagagctataggaaaataggttttgtcattaaaaataaagttttggacaggcacagtggcttatgcctataatcctagcattttgggaggccgaggcagaaaggttgcttgagtccgggaattcgcgaccagccagggcaacaaagccagaccccgtctttacaaaaaaaatattaaaaattagccaggagtggtaatacttgtcagtagtcctagctacttgggaggccgaagcaggaggattgcttgagccccagagtccaagactgcattgagctatgattgcattgcactccagcctgggccacacagaacaaggacctgactataaattaaaaaaaaaaaaaattgtatcttcctgtttccctccttggggtaaaaggtaaaaatggtgactggactcaaatagcctaatagcaacatgcacatatatatatcagaatggcctcgtgccg

SEQ ID NO: 403775 - DNA, 392 bp, Homo sapiens
tagggggaatgagggctgagtagttcacacttaatttagtagaaatgagaatcttaacttctgattaaccccaattcttctataacagtgtttctgaatttttaatgggaaatatgttcttcttcaattcattgctatctctactttcaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtc

SEQ ID NO: 403776 - DNA, 780 bp, Homo sapiens
  misc_feature (729)..(729): n is a, c, g, or t
  misc_feature (760)..(760): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacagggaaacaatgggaagatatagataaanaaatgctgatggttttcatttggattcttanaaagaattatttttgggttg

SEQ ID NO: 403777 - DNA, 3374 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403778 - DNA, 3373 bp, Homo sapiens
  misc_feature (3188)..(3188): n is a, c, g, or t
  misc_feature (3192)..(3192): n is a, c, g, or t
  misc_feature (3201)..(3201): n is a, c, g, or t
  misc_feature (3203)..(3204): n is a, c, g, or t
  misc_feature (3212)..(3212): n is a, c, g, or t
  misc_feature (3218)..(3218): n is a, c, g, or t
  misc_feature (3223)..(3223): n is a, c, g, or t
  misc_feature (3234)..(3234): n is a, c, g, or t
  misc_feature (3240)..(3240): n is a, c, g, or t
  misc_feature (3242)..(3242): n is a, c, g, or t
  misc_feature (3244)..(3245): n is a, c, g, or t
  misc_feature (3249)..(3249): n is a, c, g, or t
  misc_feature (3254)..(3254): n is a, c, g, or t
  misc_feature (3256)..(3256): n is a, c, g, or t
  misc_feature (3271)..(3271): n is a, c, g, or t
  misc_feature (3273)..(3273): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttcgngggngtaaatcancnngaggtggngacagngtacnccctttgtggntgggangnannctgnatggnangggtttaagggaccntntttctggcggaacgcctctggctatacgtcttcaaaaaaaaaagggggggcaataaaaagggggaaaaaaattaagagtaaacgcgggacgatgtacaaa

SEQ ID NO: 403779 - DNA, 3180 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcttgagctcacactcaaagatcagaggacctacagagagggctctttggtttgaggaccatggcttacctttcctgcctttgacccatcacaccccatttcctcctctttccctctccccgctgcc

SEQ ID NO: 403780 - DNA, 3320 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403781 - DNA, 3104 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaaggagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 403782 - DNA, 2548 bp, Homo sapiens
  misc_feature (2533)..(2533): n is a, c, g, or t
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaaaaaaaaaaaaaaaaaagagggggggggggaaaaaaanccccgggggggccaa

SEQ ID NO: 403783 - DNA, 2030 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaa

SEQ ID NO: 403784 - DNA, 1404 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtctacatgtgtgagttgaggatcttgatccttcatatcatactcccaaccagagaaaaatacaaaaagtcgac

SEQ ID NO: 403785 - DNA, 564 bp, Homo sapiens
agggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagatgtaagtaaaatagatggtgacaaacccgtccttgtcgcgacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatg

SEQ ID NO: 403786 - DNA, 459 bp, Homo sapiens
ataataaggaatttggactttattcttcttcatttctttaacacataattaaagacaaccacagctagatgatttacattacaaagtcccattgagacagtgtgctgttgctgcaaggataaataagtagaccaatggaaagaaaaaacactgttcaatagagcctaaatacaaacaaaaatatatatagtcagttcctttaggccaaatgttaccttatactgtagttgtgaaagcatagtctgagttaattgagtagccaaataggaaatatgtaaacaaatttgtatcttggctcctacctgacactgttctcaaaaatcagtcacagatggattgcagatctaaatgccaatggaaagaaaacatagctgttggggaaaagaaaaaccacatagaatatctttatgatcttaaattaggcaaacattaaagtggtacataaaagctctaaccata

SEQ ID NO: 403787 - DNA, 449 bp, Homo sapiens
cctctctctgggcataatggcatgttattgatcttcccaaaggagtcactcaaatgaggatgttaacacagttgtgcaaagatgtatcgatgtctctctggaggaaagatctaagtgtctgctacagctacacaaaacaatctcagtgcagctcagaaatataatgtttgccaaggaaaccagagacaaaagagtgcttattgtacataattccattcatgagaaaccgaagcagaaaaaactaattgatgtggtgagaagtcaggagaagggttatccttgaaagggagggagttataacaatattggatgtgggcacaagggaggcttctgaggtaccgagaatattctgtgtgccaattacatgggtgtgttcagttcacgaaattcactgagttgtacacatatatgtatgccataagtttcaataaaaagtttaaaaattaaca

SEQ ID NO: 403788 - DNA, 284 bp, Homo sapiens
aaggattttgtctgttatgacatagcaaagtaagagaaaagaaaattgaggtgatgaagaccgaaaatactggataataaaagtttaaaggtcaaagtttttatgaaatgaagagcaggtgaggaaagccataattaaaaaatttttaaataataatccaatgctaacttgactctttgaagttgcagattagaacattaaaaatataaacatataatactatagctctctacatatcttccagcccaagtcctaagttagcttttaatttttctgttttgaga

SEQ ID NO: 403789 - DNA, 433 bp, Homo sapiens
tgatctgaaaaagtccgtgaaagtcctagaagcaaagaaagcaaactagttaactttcaggagatgctcagtcttcctcccagacatcttctgatgtcatacacagctggccacctggtgcagtgagcagtgagtccctatgatataaaccccaggatggtccagatcctgccaaagtaattagcttatatcaaagaagtagattcaaaattaaaacaaagggattttaaatgtgaaactgtaaatgtaaaagtgcacagctgcttatactaagtgggtaaactgctttgaaattggttctgaattggctttgggttcataatgggacttgattatttccacatggtacttagcaggcacataaaattccactaatatgaaagaaatgtattttaaatgttggttgatggaggaaagaatacttttatattac

SEQ ID NO: 403790 - DNA, 438 bp, Homo sapiens
gtgcacttaagctgtttctccctctttaattcttataataaaataaaagatacagtagacatcagataatatttttgtcattgtaccattgtgccttgtgtaactttttctgcaaactgtgaaagtgttctatataatacatattttgtcttaaactttgatattaagtccattgttggttagtgtgaaacaccagaagggtgacaacattataaatttaatgtataaattagtaacttagttacctcaccagataaatgacatttatctggtatgtgaccacaaatttattcatgtatgagggaaatgttgacaaggaacaaaatacatattctatataaggaccgaaattaggccttgacattgtcatgcctttttttaaaacatgttttgacaaagtatcagattgcaataaacttgaaattttaaaacaaaaaa

SEQ ID NO: 403791 - DNA, 450 bp, Homo sapiens
gccttgcagcttactgagagaattatgggggaaaacacataaacacaaaggtcatctgtcttaaggcagcagaaaaagctgtcattttagatgtttaccttgaatctctatagccaagaaaggccaacaagagaaataattgtattccttaatatgaagctgagatgtgtttgtagtaatgaacattggtccttggagaagataagtgtgggtacagctcactattacaggttcttactcttgaccttagataatccaaaagcagaaggaacacttgctacatgttgtatttcgtgatttaaatattgtgctacagttggaagatcaaatgccaattggaatttgattactgttttattagtcctgagtaactcagactttaggaaaaagtaataccattacatcccccagctcaataaacagcaccgccacccacttcgtcgctcaaga

SEQ ID NO: 403792 - DNA, 514 bp, Homo sapiens
tctcctgccagcttcctcaactgacaaatggagctcacagaagattccatcacaattagatgagctagtgtatagacaagagctttacatggggctgtcactcagtgcttaagccgggtgtggtggttcatgcctgtaatccagcgctctgggaggccaggagtttgagagcagcctgggcaacatagtgagactctgtctcaaaaaaaatttaaaaatgtggggccgggcgcagtggctcacgcctgtaatcccagcactttggcaggccaaggcaggtggaccacctgaggtcaggagttcaagaccagcctgaccaacatggagaaaccctgtctctgctaaaaatgcaaaattagctgggagtggtggcgcatgcctgtaatctcagctactcaggaggctgaggcaggagaattgcttgaatctgggaggcggaggttgcggtgaacccagatggagccactgcactccagcttgggcaacaagagtgaaattccatctcaaaaaaaaa

SEQ ID NO: 403793 - DNA, 274 bp, Homo sapiens
atcaaaggaaaattttaagctatgaataattaattttctgggtgtttccaccttgaatgaagagatgaggaggtagaacttacatgagaaactctaagatttctcctgggtgtggggttttcagatgctcccttgactaataaacacacgcaagtttttagttttttttttttttaacttactttcaggattttgtagaattgtggagacctgtgtgtaaatgagataaactattattgtatctgagagagtgcaatgttgtaaatgtaataga

SEQ ID NO: 403794 - DNA, 524 bp, Homo sapiens
agtggctaaacatggattaaaacctagttttgactgacttcggtgcttgtgttcttaatatattgctctgttgtttgttttcgatgctttactgccacatgtcctgcctttaactagaggcttctgtattttgaggacgagagctttgctgattgttatatgcatagtatcagttattcactgtcttctaaaataccaaagaatttacttgtaaggggaaagggccctgtcccagaatcctgtaaagcaacgaagtctaacttcaccgtcagagatcaaattggttctagcagctgaccagctgggtgaccctggataaattactataagtctcggttttcccaccagtaaaatgtggcgaaaggcttttgaaacattccttactatccagaacctcgaaactaagctcagcacctaggcgggtgggtgacctcgcgatgtttctgtgcccaggcagcacatggcagagagcagccctgggcgggctggtacctcccctggaccattagcccctaacgcggccg

SEQ ID NO: 403795 - DNA, 531 bp, Homo sapiens
ggtaaagctcttgacttgactagaaaggtgaaaatgctgaataattgtagattgcattagaaaaatttataatttagtgtgtgttaaaaattcaaaagtagatcacatttgccatctttgagccccccacctctgctgcagttgtagcaggcaatacgtctgtcatccactcctcagtggcttcaccagcctttcagccagatacaaggctgttgtcctagtgattacagccacatgagtcactggtcagctcagcggctatcccgacctgctgcctgactcccataatcttcacccatttatgagtgagaacatgcaatatttgtctttctgtgcctggcttgtttcacttaagataatgatctctagtttcatccatcttgttgtaaaatacataatttcatagttttttaatggctgaatagtattccattacatatgtataatacttttttttatactttcatttattgatggacacatgttgtattagtctgttctcatgctgctaataaagacatacctgagaaa

SEQ ID NO: 403796 - DNA, 468 bp, Homo sapiens
aagtgaaatagagggaaaaagtcctttttaaaagaataggcacaagggatgtttttcttaattataaagacagtatttagagtaagataaaagtataattgcagttgcttaaggcttgaacagttttcaggaaaaaaagtcccgaatgttactttctcagtcaatttcaataaatttctcaggggtctaacatttatttcaaccccagccatacattttcttcctaagtggtcttttgcattgacagtatgtagtgtgagagactaataagatgatcgtgcaattccagtgatattctggtttgcctatcatttaatgattatcaattaatcatttaataccctttaatggccaacttgattttcagggttttgttagataagaccatacagtgctttgttaattaaaacgtgatcttgggaagcatgtaacttttatacaaaataaacttttatacaaagcagagcc

SEQ ID NO: 403797 - DNA, 566 bp, Homo sapiens
ttttaagaacctattattaaacttttacaagaagactgttaacttaattccttgaactactgacttgcatctctatgagtctagaaacctactctgtcttgttaactgtcgtatcttcagggttcacagcaccaagtaggaactcaatagttatttgtttaaggaataaatgaatggaatgtttatacaatgtatacagttagaaaacctattttattctttttaaatccttgaatgaaatttaatttatttgctgtatctaaaggctgcactatgacagaactagtataagaatccatttctcttcatttcttagtactctttttatgaagatacactgtctatttggagttagactttttaattgtatacccaaatatatgtaagccacacaaattagagtacttttattaagtaaatactgttgattaataagaacaaagtcaactatcttaataatgagttaatactccaaaaagcattaataaaagcaatgtgcatccttaagacattggccaagataaaaatttttttgcatttccaaaatgctttctttccagtggtaa

SEQ ID NO: 403798 - DNA, 586 bp, Homo sapiens
gctagttcagccaggaggccctgcgcggctccggggagagctgggtggttatgccacctcattagacacattggtggacgatgccgcggattagcgggatggtttgtgtacaaacgaagccgtgtcacttctcaagtgtcggtgctcaacgtggcaacgcccctcccgcccccagtacagagatcctgcccatccaccgacaatccccctcctcatcttccttcccccaggtgcgagtgattcaaggaaatccgactggagggaacacacgctgcgatgcaccctctcctcttccattgagccaggggtgaccttgagagactcaggccacctcaccaggctctaccaggaacagcgtctacagctggtagagagcacgggctgcagagaggtaaagatggggttcggaagccaaggctccccttgttgcatgggtgacatcaggcaagctactcaacctctaaccctggcttccccttctgtatactggagacagtatcggccccacaggcacttgtggagcaagtgggtttgagctgagctcctctgaaaatcagaggcacactcagagagtagctcagaaaac

SEQ ID NO: 403799 - DNA, 615 bp, Homo sapiens
gctagttcagccaggaggccctgcgcggctccggggagagctgggtggttatgccacctcattagacacattggtggacgatgccgcggattagcgggatggtttgtgtacaaacgaagccgtgtcacttctcaagtgtcggtgctcaacgtggcaacgcccctcccgcccccagtacagagatcctgcccatccaccgacaatccccctcctcatcttccttcccccaggtgcgagtgattcaaggaaatccgactggagggaacacacgctgcgatgcaccctctcctcttccattgagccaggggtgaccttgagagactcaggccacctcaccaggctctaccaggaacagcgtctacagctggtagagagcacgggctgcagagagatggtaacaagaaagtaggtagctgcaggggctgctggcagccatcttgagacatgaaaggtgtccaaattgggatgaattcagcactgaagatggtggtacagagaaacaggagatagggcctttgatcacattgttggatggctggttaagcctctcctgaaatccattctactgctggactttacagttcataaactaataaatcctctttactgtttgaa

SEQ ID NO: 403800 - DNA, 350 bp, Homo sapiens
tgcaaatgttcatgtcagcattatttaatagtcaaaaagtagaaatgacccaaaatgtctgtcagttgatggattgataaagtatggtatgtcattctgtatatgacatgtccagtatagccaaatctatataaacagaaactagagcagtagttgcttgtggcttggagtgagaatgggttgggaggaatgaggagtgactgccgatgggtactttcggggacaatacaaatgttccaaagttagtttacaatgatgattgtacagttgtgtaaacgtattagaaaccgttgtaaagtttaaatgggtggattttatgatatgtaaattatatctcaagctttttaaga

SEQ ID NO: 403801 - DNA, 778 bp, Homo sapiens
aagcaagaaaggtaacattgaggaagcagaagtggcagtgcatagaaggaagaaagaaggacaaagacacaggaatgcaggaaagtatcaatgtttagggaagaaccaaaaatgtttatttgggcaaaggatagacaatctgggaaatcaggaaagaaaaggttaaaaacacgtaaaggtagtttaccaaattgcaaatttgctcttaagtataccagagacacattaaagagagcctctatgatgttacttggtagcagtgaatgaatacgatggattggcctggattatgagagacactgagattctgaaaccttaagataataacagatgtggcaggagggctgaagtttcaaagctgagtcatggggagaattagttttcgtgtaactagttgagaagtgagaatcaagaactgattttgatgagggaagatgattaattgatatgtatttgaggtatacacaatatattcacactgacttatcaaaaagacctttgaaaattgggtgtggtccttgaaaagtgcctctggagaacatgcaatgtactgtgtaggttaccagcattggctgtgaaatcagattgccaagattcaagaagtggctctgccacttccaagttcttgtgaccttctcaagccttggttttcttatctataaaactgtgataatcaattttgcgactatgataatcaattttgtgattcatttgcacggagaagatagtagaagctatgctagtggataagataacaatggagagtatagaaaggaaa

SEQ ID NO: 403802 - DNA, 466 bp, Homo sapiens
ttccgagtagttgggattacagacatgcaccaccactcctggctaacaagaagagcctttcgcctctagccatgattctgagaacttcccagccatgtggaactatccatgtacaagtatattttttcattacaaataactcaagaaaaagaaatcattgaagataaatgaaacgctgtattacattttatgccagattcagcttcttgagagcagtgtctgtttcttactttgttgcaaatgtacattcaccaatcaggcacttgttaaaaagtgcttgaaacggcaaataataaagacgactacttttcagatattgtatctcagcagagatgctgaaaaaagaaagagagaagaatgaggtctttgcagaaagattggaagatgaagaggagataagtagagaaagaaagcaccaggatggaaaaatatgggtcttgccttcaccaaatgaacttgtgtttca

SEQ ID NO: 403803 - DNA, 158 bp, Homo sapiens
aatatgtatgagactcctttggaagttcataatttcatgggagaattggttgtaaacaaataaatgcaaaattgacagatgtgtcctctggaaatagaggagataaattattattggctcttaaaggccaagtagaattttccagctaaagagaagga

SEQ ID NO: 403804 - DNA, 686 bp, Homo sapiens
gtcatcgagccggcccggattgctgatctcaacgtgagtaaagtttaataattcaaagcagaatttgagcttcaaaagaataacaaaatagtgttgcaaatataccattttctgtaaagaataaaagctacatagttttaggaaagcgaaggaaatcctgactcttggtttaactgattcattcactgcctcatttgtttatcaaatacttacttaacagatactgtgtcgacgtgtggctcaggccatcgagacacagcaggggacaaatgtttatacttgaggttggctaactcattaggacaataagtgagatttataatgcgtgccttatttgtacttttagattataaagactggttatcaaatacacataaaaaagaggagattttctttccaattgagtcttctcctgtgtgcagggaatgcatgccttgcctccctggctcgcctctgaaggtattttataaatttacggtgacctgagatatgtgactcagaactgactggaccggcactcgccggtcagccactcacatttcagtccgcggccctttatgctgttgttactcacactgcaggccgcggccctttatgctgttgctctatgccactgattcactgctttctcatcctgactagaatacagactcgttgagatcaggcaatccgggccgagctcgcag

SEQ ID NO: 403805 - DNA, 396 bp, Homo sapiens
aatcaaatgtctctggagttagctggtaatgtaagattatgaattggtaacaaaattcacagccacagtctgagatattttgggaccacgtgagctggctcacttaaccagggtcaccttactagtcctgatgcctggatcttggagtaactagcttccctaagcggttacacaccattcagaatgaatgaagacatgtgcagagttaggagagagatgagtaggtcagtttcccgtcttactggcatccagaaaattaagtgctgatctcaacgtgagtaaagtttaataattcaaagcagaatttgagcttcaaaagaataacaaaatagtgttgcaaatataccattttctgtaaagaataaaagctacatagttttaggaaagcgaaggaaa

SEQ ID NO: 403806 - DNA, 1096 bp, Homo sapiens
taattttttgtgtttttagtggagatgaggtttcataatgttggccaggctggtcttgaactcctgacttcaggtgatctacctgcctcggcctcccaaagtgcagggattacaggcatgagccaccgcgcggcccaggatccatagttttaacatggtggacttagttatgtttatcgaatagggtgatggtagagatcttggggtactggtaaagttcaatattaccctttcagggtttaggtttccacattcctttcttacgccaaatcatgtattgtctcatttgaaactcaataatcctgtaagtagtattcttttagctttacagataaggaaatttatttatagattgattgttgttgggttttgttttattttgttttcttccagacagagtcttactctgttgcccaggctggagtgcagtggtgcaacctcagctcactgcagcctccacctcctaggtttaagcgattgtcctgcctcagctggtattataggcgtgcgccaccacgcccagctaatttttgtatttttagtagagacagggtttcgctatgttgcccaggctggtcccgaacccctgagctcaggcgttgagttgctggcctcagcctcccaaagtactgggatttgattattaaatcccaggttttagaatctaagttaaagattatcaataaatagatagcagtgaataattttttttttccttttaggggcttaaagtacttaaatctctgttgaacagtggataccaccagttataattactttgggagatggtgatttgagtctcttaatctgtgaaatattagaaaagtcttggctaggcacagtggctcattctgggaggcagacacgggaggatcacttgaggccaggagttcgagaccagcctgggcaacatagagacaacatctctacaaaaaatacaaaaactagccaggcatagtggtatgaacctgtagttccagctactcaggaggctgaagtggaaggatcactggagcctgggaggtcaaggctgaagtgagccgagactatgccactgcagtctagcctgggagacagagggagaccctgtctcaaa

SEQ ID NO: 403807 - DNA, 657 bp, Homo sapiens
taattttttgtgtttttagtggagatgaggtttcataatgttggccaggctggtcttgaactcctgacttcaggtgatctacctgcctcggcctcccaaagtgcagggattacaggcatgagccaccgcgcggcccaggatccatagttttaacatggtggacttagttatgtttatcgaatagggtgatggtagagatcttggggtactggtaaagttcaatattaccctttcagggtttaggtttccacattcctttcttacgccaaatcatgtattgtctcatttgaaactcaataatcctgtaagtagtattcttttagctttacagataaggaaatttatttatagattgattgttgttgggttttgttttattttgttttcttccagacagagtcttactctgttgcccaggctggagtgcagtggtgcaacctcagctcactgcagcctccacctcctgggcaacatagagacaacatctctacaaaaaatacaaaaactagccaggcatagtggtatgaacctgtagttccagctactcaggaggctgaagtggaaggatcactggagcctgggaggtcaaggctgaagtgagccgagactatgccactgcagtctagcctgggagacagagggagaccctgtctcaaa

SEQ ID NO: 403808 - DNA, 2220 bp, Homo sapiens
tgcaggtggggaggagggatccagggtggggtgaagcccgtggccacaggaggcttggatgctccacctgctgcgatttcccgacaaagactgtgtccctcttttctccatctcgaaagccttccctgtgtgcggggacagacacagcctgaaaccaaagcctctggggtgcccccccgcccgccctaggccctgtgaggtcagcgtccctgggcctccccaagctggcagaggggccgtggcaggagcaggtggtgcctgcagcgtcctttccattgttctccaaaacgctctaaaacgggaaggctatttgggacaggctgttgctgtctgccgagcagagtaaagatgagtggataggtccccaaaagtgtcaccgtgcggagccgatgaggtctgcactcgggccggggtgggtgccccgatgccgaggtctcgtatctcggggcagtgtgtgagactccgtaatcagcacctgagtttggttcatttattccagctgcaatatttttatgcaacctctgtgccaggctctggggacactgctgaggaaaagggagaaaaaaacaaaaatacatctttaatgcatgctctgaaagacaagaacggggtcagagatggagggtaagtggtggtcggtcacagaccaccagaagggtgtcagtggacaccctttttattaaagagggactcttaaacagatatgaccccccgatgggacggcagatcagagaatcaggctgtgggtacattgtgttgagagcaggcaccttctagggcaaggcctggcaacctacagccctccgaccaaatgcagcccgccacctgtttttgtcaataaagttttgttggcacatggacatgcccattcatttacatatgacagctggcgccccgacaacagcagacctgaagagtcactgcagagcccacctggcctgcaaagcccaatgtatttagaatctggccctttatgggaaagaatgtgctcagccctgacttagaagaagtgggtggtggcagcctccaccctttctctatgcctgcaacaaaatgttctcccatagggacagcccctcagtgcccaggtccaccttggctctcaaaggcttccagttagatggacagtgggcagccaactgcccccgctgccacccgcaggagcgggtggaaaaaggaggctttgaccagggactttgattcatctgtccatctgtccgacccactgggggtgctctgccctctacccttgggccacctgctgcccaagtgctggggtcggggagagcctgacacactcagcctccgacccctgcagctgccccccaccaaccccaccattcacggattgggctccctccccttctgcaatggagagttctggctcccactccaccacggtcaagattcacggctcccatgacggtgctaagatcccgatgtgtctccctctctccctgtggccaccgccccgactcctcccacaacctcaaattgtcccctggccccatgaggcagctctggaactcaagagtcacagcctggtcatgatcatcagggagagaagctcccagggactcccagggccccagagacgaggcacagaacacaaggaagctgggggacacgcctggggccttggcaccagcccggggagggttatttacggattagatttactcagcgctgctgctctgttaatggagaatataaaaattatttgctgctgcaggcagtgtgaggggtgacagcagccaggaggcgggcggaagagtgggtggctcagggcatccgtgcctcccagctaactcggtgacagggacaaatgcctcccttccctgcagcttccagacggaggagggggtccttgtggccacgacagcctccacccccaccagccccagcagctgctttagaaacacaaagccagccatgtacggtggctcacgcctataatcccagcactttgggaggctgaggtgggcggatcacctgagttcaggagtttgagaccagcctgggcaacatggagaaaccccgtttctactaaaaatacaaaaaattagccaggcatggtggtgagtgcctgtaatcccagctactcgggaggctgaggcaggagaatcactagaagccaggaggcagaggttgcagtgagccaagcgcgtgccatttcactccagcctggacaacaagagcaagactccatctcaaaaaaaa

SEQ ID NO: 403809 - DNA, 883 bp, Homo sapiens
ttctcttctgcctgttctactttatttaattctaaatcatagtcgctatctaaagccaaactcctcctctttttgtatgagactcgtagcattttgtagcttctttagagaattggctgacatgtttatttctgcagtcagtataaagactgaaacttgttgcagagcaaaaaaaaattacctcactcttttgcttggaagacttgtaccaggtctttctccagcagtcgggggatgagccagggatgggagctaaccaaaacaggcacatgaaaacatgaatgatgtcaaggtggacattagtttaactctggaaggaaattccaggttggccttttgccctaaacttcttgtcattaagtaaccatttttggataaagaaagaaaatgttttttatttcacttgtcatttattgttattaatattagagagtgatagcgtgacatacagtgtattcatttttttctctgctacaagtgaaaaaatgctaattaaatttttcagataacttaagtagcattagataaaggtttattctctctcagctaatataaatttatcttttttccttagttgtattataagcaaatatctttaaaataaagttatgtcatttgtaggagcaacattttaatttctagatataaaatgtacttatttttcctcttactgatatctgtgcttttatgaatgtctgtgcctttggggctgctttagaaaggaattaaactagcaatggtattattcatgcatttaacaaaatttactggtgcctaatatatgctaggcattgccctccactgaggtaggaaaacagtgtctatgatttcatgcaccttatattctgacttaatacaatacattgtattaaggaggagagag

SEQ ID NO: 403810 - DNA, 793 bp, Homo sapiens
cagtggttccagaaactacattaaaacaatatggatttagaagtcggtagtccatgctgcgagtggaagacttacgaataaatcaatgcagcaacctagtactgctgaatcatattaatcacagcatcacgatgggcatagaggcaatttgtaaagaaaccattctccccacctctgaatctttacagtgaactataaataacttgaataggtagcagaaagaaagcagaaacagtgagatgtacatttaaaatagttaattcaaagcaacctataggttgcttctttgtataggaagaagaccattaattcgagctatgagacactggtcttatcctactcccttatagcacattgcctctaactgtggaggactcaatggagaagcccataaataaccttgtgtttaactagataagaaacactgagttaatgaaggcatgagataaaagctatggggagaggacccaggacagcacagaagaatgagagttctggttctaatgtcaactagctagttgactcaaggaaagtaaaatctctacggttacattttctcaaacgtaagttccgcttttacagtccaagtttttttgaatctgaattatttacaggccaagattctaaagatggcctttacattaatgaagggctatttatagaaaggaaaataaaaataatattttttgagtgctgactatatgccaggaattcttctaggttgttagtacatatttcacttcacttaaagctttcaattagtcctgaggaaacttaagatcaaggatttgcc

SEQ ID NO: 403811 - DNA, 295 bp, Homo sapiens
cactctggagcccccgtctcgccaggttggcacagagctgggtcagagtccacagcagtgactctgcagttctccttgccctagatctgtccctgtggcagggttcaccctggaatccccggaggcccaaccacagcagctcagcccaccccagcacactcttctcaatgactgctgataacagaggggtcgagtgtccttaaatcatttactttttacctaaatgaattctggaacctcatggggtttgggccaatagatttatcttccccagaggtaacatgacataatggaa

SEQ ID NO: 403812 - DNA, 616 bp, Homo sapiens
agaggcattggggaaaaaattgccagcagtgtttataggatcagctggagaaaagcaagcctagttgaaggaaagctttctgttataagctctaggagattctgaagaagtaggagttactttttattaataagatgaaagtggactattaacgatgcctttctgcttcccccttgatctactgtgttaatgcagtagcttcagaggaggcaaggagacaccgtgtggtctagaagctttgcttgggggctagggaactagttctgcactctgaaagaggtttcagtcctcctttttccagagagcacccctgaatttttgctagtgagaagtataagaaatcattatcatgaaattccaatagggcactgtaactactgcatagagtatagagttgtagtctgttatgcatactggactacatctacttgaatgtaggaggataccttcaactgtggaggggttcctttttgtcaagcatagttatcacacctcccctttcctctttttttcttctctcttttcttagtctcttctcttttaaacattgataaatgccttcaactgaaaccttcaaatgttgagacaataagtgtaacttgtatgtgtgagtgtg

SEQ ID NO: 403813 - DNA, 418 bp, Homo sapiens
ccagagttacagcatagtgaaacttcaagactaggtttttctggaccatcccagtgcgcatgaatcagatttaaaaagaaagaaacatacaagaaatacataaatcatactatatgacgatagcccagaagattgcatggaggatctttgtgtttcctgtagaagaaaagaaaaatggaatttccatctcttgcatcagcacttgacagctggagttattgttgaccaggcatcaagaaaggagggatatgcatcagaaatcattttgcctgaaataagcacaactccatggaggacaatgacacattttctctggtgatcttgtaattggggatgatgtaaacatgagtctaatctgcattttgtctaagaaattcttcatcatgagcatcttccaataaaacgtggttccttacaa

SEQ ID NO: 403814 - DNA, 594 bp, Homo sapiens
ccagagttacagcatagtgaaacttcaagactaggtttttctggaccatcccagtgcgcatgaatcaggtgattttatcttttgttcctctccttgctatccctaatctgtcaggcagtcctaaatctataccatcaggcttgtttgttctacttctctatccttttattatggttccattaactcacatccaaggatgtcaagagaataaatagcccaataaaacaaaagaatatacttccagatttaaaaagaaagaaacatacaagaaatacataaatcatactatatgacgatagcccagaagattgcatggaggatctttgtgtttcctgtagaagaaaagaaaaatggaatttccatctcttgcatcagcacttgacagctggagttattgttgaccaggcatcaagaaaggagggatatgcatcagaaatcattttgcctgaaataagcacaactccatggaggacaatgacacattttctctggtgatcttgtaattggggatgatgtaaacatgagtctaatctgcattttgtctaagaaattcttcatcatgagcatcttccaataaaacgtggttccttacaa

SEQ ID NO: 403815 - DNA, 340 bp, Homo sapiens
ccaagaggacatcaggctgctgtccctccccgccactgaacactcagttcctaaagagagaggattactcagaaagcagcttgccaacgctcctacccaagcttcagagccctgtcagattttgccttgaggtggaagagaagcaagctgtgaaacacatagctcctaacctcttgcctaagaattaacttcaattgcaacagatcatgagacatttaagtcaaagggcactccatccttgatgcagtggaaatggggaaatggaggtgaaagacaattcacaggagatttgtggatttaatgaagatactgcctgcactgtaggccagctaatttgtgg

SEQ ID NO: 403816 - DNA, 1082 bp, Homo sapiens
ctgaaggggatgctaagggagataaagccaaggtgaaggacgaaccgcagagaagatccgcgaggttgtctgccaaacctgctcctccaaagccagagcccaagcctagaaagtcccctgtaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgttttactttttttttttttaaaagctatgttgttagcacacagaacacttcattgttgtttttgggggaaggggcatatgtcactaatagaaagtctccaaagctggattgatgtgaagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttagcccagacatctgttgagacctgacccccagtcattggttaccagtgtgtcaggcaatctggactttccagtgatgccactgagatggcacctgtaaaagagcagtggttccatttctagattgtggatcttcagataaattctgccattttcatttcacttcctgaaagtcagggtcggcttgtgaaaagttgttaaacaacatgctaaatgtgaaatgtcaaccctcactctaaactttccctgttcagagcatcagatgaagacttcattgggttttatagtggctttctgatttttggtagtccattgaagatagggagtttgaaagttgttgtcatactgattaacgattgtctagacgaccatgtcctgcctgaaataccatgattatttatggaaagtatctttaataaagctggatatggtttgaaaaaa

SEQ ID NO: 403817 - DNA, 902 bp, Homo sapiens
ctcaggaggctgaggcaggagaatcacttgaacccaggaggcggaggtggcagtgagccgagattgcgccactacactccagcctgggtgacagaccgagactccatgtcaaaaaaaaaaaaaaaagaaaagaaaagaaaagaaaaaagaaatctaggggaaaatctgtttgttgcctcttccagttgctggttgctgcaggttttccttggttgtggccacatcacaccaacctctgcctcctcttctgagtgtgtcataacacctccctctgcttctctcttataaggatacacgtgattgcatctaaggctcactcagataatccaggagaaattttccatcttcagatccttaattcaatcacatctgcaaacacacttttcccatataaggtgacatttactcattacagggattaggacctgatatcttggggcgggggcatcatttggcccctccttgaactgcattttcttcacctgtaaaatgggactaatcaccatctttgtaccataggtatctgaggatcaggcccgattatacaggaaagatacccactgagcactgggccttgccctgcatgttcatcacactcagtaaaaagaaagagcagtttacagcggggcgcagtggctcacacctgtaatcccagcactttaggaggccaaggcgggcggatcaaaaggtcaggagttcgagaccagcctggccaatatggtgaaaccccgtctctactaaaaatacaaaaattagctgggtgtggtggtggacacctgtagtcctagctactcgggaggctgaggaaggagaatcccgtgaacccgggaagtggaagttgcagcgagccgagattgtgccacagcactgtagcatgagcaacagaccgagactccatgtca

SEQ ID NO: 403818 - DNA, 404 bp, Homo sapiens
acatggaacattttagtgtgctgtacacatgtctagtgtttcttcagactggctggagccacattattttaaatcattttagaggagcatccttactgaggctagaagtaggaactcattttttagtctactattagctttcttttaatgatctccttcagattcaccaacagatacctcacctctgcccattttcaggggctgctaattaagtaataacatttaacttacataagtgtttttttaaaacgaaactccggttatagagctttctgatcaacttagattgtaataaataccatagtgccatgttacacaggaatgttacaccccaaaaaaattcagattcggggggaggagtgaaacatcaaacccatcacatggcgaaagcaaaagatgttaca

SEQ ID NO: 403819 - DNA, 264 bp, Homo sapiens
agtgggttagcgtgcttgtgctggtcagggagggtcttgttgctttttatttttggcccatttctttgtacttcagagtgggacctgatggttagacagttagctaaagttggttgtgttttgaactgcatagaatatagaactatggccgggcgcagtggctcacgtgtgtaattccagctatgccagaggctgaggcgggagaatcacttgaacctgggaggtggagtgagctgagatcgcaccactgcactccagcctggg

SEQ ID NO: 403820 - DNA, 471 bp, Homo sapiens
ccacgtgagaaacgtaggaaaagacgctgcaaatcaaagacgaccaccctggagaagcaggagaaactccccaacttgagtgaatgtatcaacatttcagaaaatgtaggaggtggatgttactgtttaatctgctcagcatccttcccccaccccttttgataactggcctcatccactggacacacttcttggaatgagacccgggctaggccaatcagcctctccctgaagtgtttccctgaagctggaagagaggaactctgttccctcttggattacagagctgaaaggagatgaatttgatgctactagtgttcatgtttctaaccaagggagatggggcctagcaagccttaatggtcttcatatattttccatcagaccttttaagcttcccccatggtgaccagccccagagtaatgcacatttaattcaactttcaatgcaggaaaatcaattgcattgca

SEQ ID NO: 403821 - DNA, 303 bp, Homo sapiens
acataagcagggagtgattccagggtgactgaaagagggcacctgaggcaggctgtcattaggaagctttaacattcatctacacataaaggttactacttagatgggtgttacttgtactacatgctaacaagtctctgagaatttcactacccagcatgttggtgtctataaagaaggtgcagtcatatctttacctgctaaagcaaaatgacatctgtttgtctcagatacatatgttattgtttttcaaatgtttatataagcagtaccttcataaaatgcatttttgctttaaagtat

SEQ ID NO: 403822 - DNA, 376 bp, Homo sapiens
gcctggaggggtccttctacagagacaacttccaggagagaaggaactaaatgcacagggcactgaggttcaggggatgcccccaggccccggcacccatggagccccggaatcccccatcctgcagcagaaagggctcactggactgggacagtacttgctgcccaacactggccatgggctcaccaaaaagttaggggcctgtgcgctttagccctctcctgattttcctccattcctcccatctacagctttgtcctttcattcagtcaacactggcggcgggagctagtgccagaccaccaggctgggcaccaagtgggggctccagagagagtggattctggaggtgagcggtgctctttgggaggaagga

SEQ ID NO: 403823 - DNA, 222 bp, Homo sapiens
ccacactagcagtagaagagtcccttcctgtcaacaatgaagcatttggaaggaaatcagaggcatacaaccaaataggctttttacccccttgggggccatatcaacagcatggctattcaggggccatgctctgtcaccttgaggtcatgccaaagaaacttggacttatacacagatcttaattggctcttgtccccaggacattcttcttgtttacaa

SEQ ID NO: 403824 - DNA, 771 bp, Homo sapiens
atttatatatttttttccttaaagtaagattaataaagctaaattaattcttttatatttcttttaacagcactaaatcaaagctagagttgttgatgcatgcaatgtgtgtggtttttaaattacttttgaatttaaataatccctgtgttttttaatccctcactagtacagatacttaacattgaatgtttgtattctagtgaatgtccattaatagttgcttaaaactttctttaaaatatcagtgaggtaaatagcaatctggaaaagaaaagatggaaagaaagtaaatttggtttgaattaatttcttgtgttatcaaccttaactgaaggcttatatagcccagtgggatctattcatgggcaacatcatgttgccatttggcaggacccacttagattctggcctttggcaagcccctccacaaccaaggctcttccatttgaataaaaactgctcatcatcatgggtgtgtgtgtgtgtgtgtgtgtgtgtgtgtgtgtgtgtcgccttctttcatcttattgatctttgatactttacgtcttgtttcctcagttgtaagctcactggtaaaagtgagatatatttttctttcccttctttaagacaagagcagagcttgtgtgagagctctggactttcactgctacagaatttaaagatgtggtttttcaaaagtctaaggcctgatgtttcttaagtctgaatatgcacaggaatctactgatgaacttagtgaaatgcaaactcctgggacacaac

SEQ ID NO: 403825 - DNA, 474 bp, Homo sapiens
caaggaattgcattcgcctgagattgaggttcctataagaaagaggcaatgaaagacatggttgggaagagagcagaggccaggacgggtcttctaccaaactaagaattgctgttgtgttcatcctgccagaagtggtggatcagtgaggccttttaaacaggagagtaagttagatttatttttaagaaagctcactttagtcataatatgaacgttgtctgaagggatgacggtaggctggccacagtggctcatgcctgtaatcccagcgctttgggaggccaaggcaggaggatagcatgagcctaggagtttgagaccagcctgggcaacatagtgagacctcttctctacaaaaaaattttttaaatcagctgggcgtggtggcctgtgcctgtagtcccagctactcaggaggctgagatggaacgatcacttgatccctggaggtcaaggtgcaatcacggctca

SEQ ID NO: 403826 - DNA, 361 bp, Homo sapiens
ggatcccttattccctggaaatagttgcaaaatttttgacagaaatacacacatattctgagtatgtgtttgcctttttggtcacaaaaacacaaccgatactgttatgcaaggacttacattgttttgacccacttgcaaaggatcacacacaccgtcatgttaaatgcaggaaattacagcaacagctgtgcaggagtcagtacaagatcatgggatctactggccagatttatatactgtatatactataagatgcagaagttgttggcttgatggaatgatagagaagactgttgaagacacaatgcagcagccactcacaggcagtatcttgtgaggctggagcactattctccag

SEQ ID NO: 403827 - DNA, 527 bp, Homo sapiens
tgtaaaggactggtagaattagcaatcagtcaacttgagtgagggtcttaaagaagtacaaggcttattctccgacttcagggtgttcatagttcatgggaatcatgcatacacacaaaccagaataaaccattttgaagcaaatgtgcttgaagttcagcacatctccaggaaggagagggtactgtgagctagatgaactgggtgcacagactctgtcttgacctttcactttatacccaattctttaggctaaattttgacattctaattggacttccagagttagtagttctcacactaaagactgtgtaattacaagttaaccatgtacaggttggtgatagaagcagaagtagatatttctgggctatgcagggctatggtaagggatttggaatgaaataggtctgggcttaaatcttgtatctctagctatgaacttcagtttcctcatcagtctattggaatataactaccttttagggttgtggtgagacttagaatatctgtaacccctctagtgg

SEQ ID NO: 403828 - DNA, 459 bp, Homo sapiens
agtagctgggattacaggtgctcaccacaatgcccggctaatttttttatttttagtagagacggaggttcaccatgttgatcaggctggtcttgaactcctgacctcaagcaacccatgcgcctcggcctcccaaagtgctgggattacttgaagccaggagttcgagaccagcctggccaacatagaccgcgtttccacaaaaataaaaaaaaagaataaaacaaagaaaaacaacgataaataaacttaacagctttaaagaaaagccacgaccacagaaggtttacaacgagtcatctgcgccaagcagcggcacctgagacgctgcgggcggggagggtggggtccgagcgccagcgctgaccgcctgggtggaggccgccccgggccccgggcctcgactaccctgccgcgtccgggcaccggcgctcggctcccacccgggcgtctgagcct

SEQ ID NO: 403829 - DNA, 544 bp, Homo sapiens
cagagtctcactctgtcacccaggctggagtgcagtggggcaatctcggctcactgcaagctccctcccaggttcacaccattctcctgcctcagcctcctgagtagctgggactacaggcacccgccaccacgccccgctaattttgttttggtatttttagtagagatggagtttcaccatgttagccaggatggtctcaatctcctgatctcgtgatctgcctgccttggcctcccaaagtgctgggattacaggcatgagccaccagtccaggcccattctttattatttgtaccacatgtggcatcatcctaaagtcactggaaactgggagcacaagggccacactaggtcctgaagaaatcccgaggtgagtgggaactgtcattaccaataaagagctacctcatttaagtggtctctcctttcagcagagcacagtgtgctgctgccatggctgctgccagcaaaggctgccttccagatcggctcctttctggacatgtgcaaggaaatgtcctgggcaggcaaagtttccatt

SEQ ID NO: 403830 - DNA, 838 bp, Homo sapiens
cagagtctcactctgtcacccaggctggagtgcagtggggcaatctcggctcactgcaagctccctcccaggttcacaccattctcctgcctcagcctcctgagtagctgggactacaggcacccgccaccacgccccgctaattttgttttggtatttttagtagagatggagtttcaccatgttagccaggatggtctcaatctcctgatctcgtgatctgcctgccttggcctcccaaagtgctgggattacaggcatgagccaccagtccaggcccattctttattatttgtaccacatgtggcatcatcctaaagtcactggaaactgggagcacaagggccacactaggtcctgaagaaatcccgaggtgagtgggaactgtcattaccaataaagagctacctcatttaagtggtctctcctttcagcagagcacagtgtgctgctgccatggctgctgccagcaaaggctgccttccagatcggctcccagatgaaggggctgttttccaggggttgatcccaggaaacataaaagtggagaccacctggggcttcagtccaccctgtgatgttattcttgaagattaagataatttaggaagagtaataaaaaatatgagctaatatttgttgtgtgtttgttatgtcaggcactgttctaagcactttgtgtgtgtgttcaggctgaatcattggaacagcttttggagggacatgcatgtattaccctgacagtccagtcactccactgccccactcatctggatgactgtgtcactcctcctctctcccaaagctgcaggggtaccaccttcctcattcttgctgt

SEQ ID NO: 403831 - DNA, 858 bp, Homo sapiens
  misc_feature (512)..(512): n is a, c, g, or t
cttgtttgatcattggagatttcaaacctgttcccccatgatattgacaggtgaggaagacttgtgagaaaggagcccatccaagacatgttccttgttgctcatcatttccagatgagctgttaagactccttctgattctcttctttactttatcccaagcctcattgggtcccttgtctttacctagacataattggctctataaagtatttgggtgaggctttaggcagagattgagtgtagcctggtctggttgtaaagttccctgacaccttgaccgtgggtctgagagaacagaaatacagctccatcgttggcccgctcttatgctgggacatgcatttcctgttgaaacggccatggggtagcacatgctgaggactgcagtgaggaaatatgctaccctttgttgcaggacagccccgtataatgtgttaaacacatacttctcatttatctggaaatttctttggaagtaaatgtctctgaattggaagccagatactctnagaagctatggggttttttgtggatcccaatggtatcatttagaaaattattgctttagggtccaggcatggtggctcacgcctgtaatcctagcactttgggaggccaaggagggcagatcacttgaggtcaggagttcgagaccagcctggccaacatggtgaaactctgtctctaccaaaaaacaagcaaaaaattagctgggcatggtggcgtgcacctgtaatcccatctacccaggaggctgaggcacaagaatcatatgaaaccaggagtcagaggttgcagtgagctgagatcatgccactgcactctagcctgggcgacagagcaagactccatctc

SEQ ID NO: 403832 - DNA, 161 bp, Homo sapiens
aaaaaagagtgtgcagaacaacacagctgaagaacacattcttagatacatcaaaatgggataatccagttgataccattttataaccttggcaacatgaggataatggttcatcctttcatgtcattttctagtctgtgctatgtaatttcaagtgcctt

SEQ ID NO: 403833 - DNA, 353 bp, Homo sapiens
tgtgcactgaaataatattcaactaaagcataattgaatcctggccagtggtgaaggaaagtgatatcccagggaggaccctgaagctccctagagcagggttgctcagccacaccgctattgacatatggggccagatcattctttgctgaggaaggctgtcctgtgcactgtaggatgtgtggcagcatccctggcctctacccactaaatgccagtagcacataccaccaccatcacttccctcccaccaatgtgacaagcaaaaatgtctccagacatatgtaatgtcaatacacatatccccacagaggggaagggcacagttgtccccagttgagaaccactgcccc

SEQ ID NO: 403834 - DNA, 480 bp, Homo sapiens
atgtagctttcctgagttaggttgcatctgggatgcagtgaaaggtagcagcagtctcgctgtggctgtccagtccagaagcagaagaccggcacctgagatatcaaggtatccaatttgggaatgctttttctgtgggtgtgtagaattgcaggaaagaccatagcatattccctgaagtgaacccaaataaggtctgggataaaaaatctgaatctttaggcattaactgtgaaaatgtctagtcagaatgtctttaaaatggcagcttctcttatcagtgtatttgtgctgagaaaaaaaaataagtatagcttctcagtttaccttctctgatccagggacaagaaagaagaaaatgaccactacctcttcttaataagaccccttgatctctacactctccagaaaaccacatcaggatttacctcacagggtggacaaatctgaaacattctaaataaaagtttgaaattccca

SEQ ID NO: 403835 - DNA, 1092 bp, Homo sapiens
aacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagtgagtgagatcactactttcctttactattttctttaccttgtatatattttattatatgtagattgttttgtttttcttcaagaatattaatttctttatttgtcatcatttatttcccatggtcgtctacttggattaaatgggtttttaaattc

SEQ ID NO: 403836 - DNA, 665 bp, Homo sapiens
aacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaaatggttctcctgaagaacatgcaatctatgttgggatcatttcatagctcaggctgctgctgagaatgtg

SEQ ID NO: 403837 - DNA, 991 bp, Homo sapiens
aacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgcctcttgattttcctgataccctggaaggatttgaatatgcttttaatgaaaatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagtgagtgagatcactactttcctttactattttctttaccttgtatatattttattatatgtagattgttttgtttttcttcaagaatattaatttctttatttgtcatcatttatttcccatggtcgtctacttggattaaatgggtttttaaattc

SEQ ID NO: 403838 - DNA, 968 bp, Homo sapiens
aacttggtcggggcgcggatcccgagagggaaagtcataacaaccgcacgagggagttcgactggcgaactggaaggccacgcctcctcccgcctgccccctcagccctgtggctgggggcagagctcagatttattatctaggatagatttggatgaactaatgaaaaaagatgaaccgcctcttgattttcctgataccctggaaggatttgaatatgcttttaatgaaaagggacagttaagacacataaaaactggggaaccatttgtttttaactaccgggaagatttacacagatggaaccagaaaagatacgaggctctaggagagatcatcacgaagtatgtatatgagctcctggaaaaggattgtaatttgaaaaaagtatctattccagtagatgccactgagagtgaaccaaagagttttatctttatgagtgaggatgctttgacaaatccacagaaactgatggttttaattcatggtagtggtgttgtcagggcagggcagtgggctagaagacttattataaatgaagatctggacagtggcacacagataccgtttattaaaagagctgtggctgaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagtgagtgagatcactactttcctttactattttctttaccttgtatatattttattatatgtagattgttttgtttttcttcaagaatattaatttctttatttgtcatcatttatttcccatggtcgtctacttggattaaatgggtttttaaattc

SEQ ID NO: 403839 - DNA, 437 bp, Homo sapiens
tgaaaattgaaatggattataagatttaaattatgctaccttctttcatttcaaaacaggaaggatatggagtaatagtactaaatcccaatgaaaactatattgaagtagaaaagccgaagatacacgtacagtcatcatctgatagttcagatgaaccagcagaaaaacgggaaagaaaagataaagtttctaaagaaacaaagaagcgacgtgatttctatgagaagtatcgtaacccccaaagagaaaaagaaatgatgcaattgtatatcagagtgagtgagatcactactttcctttactattttctttaccttgtatatattttattatatgtagattgttttgtttttcttcaagaatattaatttctttatttgtcatcatttatttcccatggtcgtctacttggattaaatgggtttttaaattca

SEQ ID NO: 403840 - DNA, 378 bp, Homo sapiens
gagctgggttcctggaggccagggacttgaggattcagttcagaattgaaccaaggttggaaaaagaatctggaacatacagaagtcagttaggaaagaaatcccgtcagttttcacccccttttctttagaagctggcctcggtacttccatggggcaggaattgtatttttgtgtcctccaccatctcttctgtctagaaatctccgtctcatcctctgggagcggccacaggaacacagccacccccgggagaggcttgcagtctctctgccctccataccccccggctgctgcctcgccgtgttcctggcctgcagcaggcctccagtgaggctgtgaaccggccagacctggggctcccagagtctggtcagg

SEQ ID NO: 403841 - DNA, 579 bp, Homo sapiens
aaaagtgggtatttggacacatgatattcgcacatgagtgtctcagaaaaataagcagaacttatatgaatagaccttttatagtattttaaaaataagaaaccatatttttctgcttgctgaatataataaaaactattattttaaatgaacatccttcctctcaaaatccacactatatggattcatactacatactagatatagatagaaaaaaggctcacaaaaatcactgtaaatttaacttaactgttttctaaggtaaaccaatcttattaataaacaaaattgcatttgtatagctgcttctttcctacttccttattgactgtgctttatactataatgggcttatttaaaacattttcctagaagttcaaaatttactgagtcaatctttctatatgtcaatgaggaaatggagttagataaacaatttaatctgtgctataaaatcatagtgctttggaaactggatatctttgcataaagcaagcattccatgtcttaagtttgtgatttgctcggcctctagcctttctggtagatctgactataagacataaactgtatagtcag

SEQ ID NO: 403842 - DNA, 314 bp, Homo sapiens
tgctgggtatgccaagaatgcaaggccctaaccattttttacctgggtcatttctcagagttgtgtttgcagtgatcaaccctgaaggttgaggtaatatctccctccaggacaaaaagcaatctggcttactttctgctgtgaaacagtaggaccctcaagctcagtgttcctctcctataacactacccaccctgtgtccaggcagccatctgtgcccatttgtattacccctcatggggcttgagggcaggaaacagaaatgatgctcatactgactgctgtgctgcaaataataaagttcattgtttcta

SEQ ID NO: 403843 - DNA, 365 bp, Homo sapiens
cagatttgaaaagcttgaccaatagggactgcttagcttggtcagcagaatggccccaaggtggccctgcgtgtgttgtgatacgtgcgggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaa

SEQ ID NO: 403844 - DNA, 468 bp, Homo sapiens
agaggaggacatatgtgaggatatagtgattgactgatgtgagaaatgtggagggaatatcatcgtgtcccatcccatcgttttacagatgaggaaactgaggcccagaaaggtgacagagctaagaccagagtccctgctttctaactcgagacagttcttcttcttgtcctttgactaactcacctgaacagtcaccagatagcaccagcattccagcctgcctaccctgcttcacccacgcctactgcctctgaagaaagggaagaatctgtgtccatcagaacatgccggggataccaggacaccagcctgctgcccaacctggctgacccgtctgctcacggaccctgtcttaatgacagaagccactccaagagttcactgtgtcctgcagtagccagttaaattcatgtaaatcctgtttgggcagtcagtggaatttttaatactcttctcctttaaaaa

SEQ ID NO: 403845 - DNA, 437 bp, Homo sapiens
gtacatccaaaggtttattgtgaaatatctctctatacactataagtgtctctagggtaggtaaaatgagttattcatcctttatactcaggttgatttgttctctttcactagcatgtctacatatttaactgttccagtaaattttaaattaccaagtcgtacttttttaaagagagttttcagttgtccccataaaaccatctgtaggaggttacctcaaaattaacccttagactcccagggtatttgagatggtcagcccccacttagaatcccatggtgtttgagatggtcggccccctctttgccctgtcctggcgttttatggtggagagctctaactcggctaactctgagagagccgaaggaaagtgccttgtcctttgtttcagagagcagaaggccagaaataaaccccgtgttttcttccttca

SEQ ID NO: 403846 - DNA, 445 bp, Homo sapiens
gttgatcctacaacaacacactttcctaaggatgatgacaactcgcatcacccctagaacggctggtatgaaccgagtttccacacagtctggctggcattgcagtcaggagatgtttggctacttcacatgttttgaacactagtaaatcttaagcttcctgagtcgagaagggagagaaatgcatgcacgtgatccactggcctgtgtgggattccttgtggcatctgaaggccgtgattcaaaggtcccctgacaaccttcccataaatgaaccaactgatcctcacaactggagagagaattaacaccttccatgggacaaagaaaaagcacattctggcctgctggcaagtcacctgtcgtttccagctcatcttcatcgctctgtattcctactctttagtaaatatgaactattaaaagcttctatgagatgcgctat

SEQ ID NO: 403847 - DNA, 285 bp, Homo sapiens
caggaagagttagcacaatgagttaatgaaattttgtcactgtataaatggctccagtttttttttcttatttctctaagataagggtatagggaggttctagattgtaaggatgtcagttaggggaaaaggagatgaaaacagtggatatcagagattctgaaactagatatttttcccaggattgtccttctaggtaatttgaattcagaacttgacacaaagcaggatagttgtgccaagtggctttacgggtgtgcacttgcaatagcaacaaatttattt

SEQ ID NO: 403848 - DNA, 352 bp, Homo sapiens
agttgaggctgaacccaggcacagtcgcaacccggcccggtttgtgcaagctcagggcagtgctgacgtgccagccccctgccacctccgccccctccagactttcggcagtgacgagcacaagagggaggttgaggtgggtctaagagtggctcagcactggcctgaaggcactcctcagctcgaacagcctcagcaatgtgggcacagctaaccacagtgcgtctctctcagctgctgagagctgaacagacgttgggatgacctgccaacagaaaggagttacccactgcagttctcctctgagctgtactgttgctcaataaagcacctcttcaccttgctcaccttc

SEQ ID NO: 403849 - DNA, 496 bp, Homo sapiens
atttctgaagtttgtttaggaaacaagtatgtgactaccttcctaagagctgactggttttttgaggcctggattgtgtgtgtatgtgcttatgtgtgtgttataaaatggaatcaactataccaggttaaacaaatggacaagtcatggaaaagacacagctctgtttggacattaataagggcgggtgtggaagctggaaagctgagatgccggaaggctcagtgcttagtaggcccggaaaagcaatttttgaactggcatctcattccccttttctaagacaggaaggacggtcagagatgattccaacatgaggactttgctagttgcagtgtctgactcctcccattctcatagcagttttgcacagtagttttggtttgtgtgtatgttttaggcaatgtgacaaagcagttttcctcctgcctccttgagaaatttaatcctgacaggttctttaagaaatcagcttgatgtgggctgattttaaaag

SEQ ID NO: 403850 - DNA, 350 bp, Homo sapiens
tgggtccaatgctgggtcattcttgctgcttggcagactgagtgcctgccttgactcccatcctcacaaggctagtgcagcctgcccttttctctttgtgcaccttgcctccctcctccccacccctccactagccgagcagacacctgacttggggcaaatgttaaatacagtctgcatgtagggctggcactgcctggactgtcactatatcctggactgtcactgtctgtcactgaaagctgttattttcctgagcattttagtattttaataaaatgtcatttgaattaaaccatttttagatggaaaattgagatattttcttgacttgctttaaaaaaaagaaa

SEQ ID NO: 403851 - DNA, 480 bp, Homo sapiens
actttgggtaaagcttctcttctaaattccagcccattgcagaccagcacaatcctctttcctggatccccattccgcagggacactctccctatgaaaagaagattccagggaaaaatccttcctcctgcacaagggccaccatgagtgagtttgccctgctaagccgtgggcttgacttcttgagaagcacatgcagaactcagttgaggccatgagccggggaaaatggtgaatctcggaagagaagtcctatgcctgccttagcactgagctgtgcacttctgagagtgagaggagacaccatcaataattgtcttgggacaactggaataaacagtgactgcccagagaactacgatatttgaaatcttatttcttgatgaatattcatcctgacttctttcctgaaatgctgtttgcaaagagagtgacttatatgtaagtagagcgttttattaaagcaagacttaatacaga

SEQ ID NO: 403852 - DNA, 513 bp, Homo sapiens
aggtgcgagtgggggtgagtctccctcaggcttggctgggtctgacaatccgagtatgccgtgatattgatagcgacaggaggcagccaaatgcctaggtagataggggcaggtccctggtgaaacctcacctccaagctgaagagtttaaagcctgaaagtcaagttgcaagttaaatccttgggctggattgagaatttatatttggcgtgctttcctctgattggtcctcgcacttcacctattttacatatacctactctttcctaattggttttctatactgttgggcccacctttgagtgatgtctttgctttaatcttttttgcatactcacaaaccaatcagcacacactccccattctgagtccataaaaccctatggacataaaagacaccagcccagccacatggggaatgttcctgcctttgggtagggggaacaaccccgtgtcctctctctgctgaaagccgttttcatcactcaataaaattattctctgccctcctc

SEQ ID NO: 403853 - DNA, 420 bp, Homo sapiens
ctacctatagcatctagatagttaatgaaaagtatgtttagatttgaagatgattatgaatcagataatttaaattttccataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaaca

SEQ ID NO: 403854 - DNA, 430 bp, Homo sapiens
gggagtggtacaatatttttcaagtgatgaagcaagactatcaacccagaatcctctactcagtaaaaatatattataggctagagggagaaatcaaaacattctcaaatgaagaaaaactaagcaaaactttttccaacatacatacctcaaaagaatggctaaaagaaattttctaaatagaaagataatggtaaaagaggaaaccacagaaaagcgggaacaaacaaaaaaaggtagttaagcaaaaatatgggaaaatacaataggcttcctttgtcttgagttgtctaaattatgtttgacacctgaagcaaggatatagctgtctgacatgattctaaatgtgtgtacaggaaacactgtaagatgattatattacaaatggggtaaagagccataaaggaggtaagacttctacacttcactc

SEQ ID NO: 403855 - DNA, 728 bp, Homo sapiens
agcctgactaacgtggtgaaaccctgtctgtactaaaaatacaaaaattagccgggcatggtagcgtgcacctgtaatcccagctacttggaaggctgaggcaggagaatcacctgaacctgggaggcagaggttgtggtgagctgagatcgtgccattgcattccagcctgggtgacagagcaagactatctaaaaaaaaaaaataataataataataataataataataaaatagggaaaaataacttttattataaactactcacttaagaattccctagtcaaaaaccagtacctgttttggttgggctccggctctgatatgctgctggtgtgtgctggtttggcatccatctggtcattctggcatctgctgtattcatagttgaacaactttaaaatcaccctgctcagatcctcactaaattcccctctctcagacttaggaatatgaactcttgatctccaaggagggcctccttaaagtcagattgttataggttgtttctgctttatgaataaataatcatccccccctggataaggaatctgtaccaggttagtatagatatgccactgatggaaaacaaaagttggcaagtaaagttatcaagtctcagattcaataaagctcttattttgattgagttctagatggtattaagtacttatacaaatttaaaatatcaggtctgaaagacttccaggaagaaaagaaatggaaaa

SEQ ID NO: 403856 - DNA, 783 bp, Homo sapiens
agcctgactaacgtggtgaaaccctgtctgtactaaaaatacaaaaattagccgggcatggtagcgtgcacctgtaatcccagctacttggaaggctgaggcaggagaatcacctgaacctgggaggcagaggttgtggtgagctgagatcgtgccattgcattccagcctgggtgacagagcaagactatctaaaaaaaaaaaataataataataataataataataataaaatagggaaaaataacttttattataaactactcacttaagaattccctagtcaaaaaccagtacctgttttggttgggctccggctctgatatgctgctggtgtgtgctggtttggcatccatctggtcattctggcatctgctgtattcatagttgaacaactttaaaatcaccctgctcagatcctcactaaattcccctctctcagacttaggaatatgaactcttgatctccaaggagggcctccttaaagtcagattgttataggttgtttctgctttatgaataaataatcatccccccctggataaggaatctgtaccaggttagtatagatatgccactgatggaaaacaaagtgtgtttacctcagaagctacttttaaacaagacaggatggttattccatagacagttggcaagtaaagttatcaagtctcagattcaataaagctcttattttgattgagttctagatggtattaagtacttatacaaatttaaaatatcaggtctgaaagacttccaggaagaaaagaaatggaaaa

SEQ ID NO: 403857 - DNA, 227 bp, Homo sapiens
taaaaagtaaaatgttgaaaattcaaatacaacgcaggagatggctatatgtatttctgttcatacggctttattaatttggttaaaaatttcattattggccaggagcgtgtctcatgtctgtaatcccggcactttgggaggcagaggtgggagcatcgcttgagtccaggagttggagaccagtttaggcaacagagcgagaccccagtctctacaaaaagttt

SEQ ID NO: 403858 - DNA, 357 bp, Homo sapiens
taaacaagagttaagaaagatttaagaacgattaataaaacaagcaagataattatttaccccattattccagttcacagtcatgagtggctggagcagctcagggcacaaagtgggaacctgccctggccaggatgccatttcattgcaggctgcactcacacccacactcactcagactatgacaatttagacacaccagttcacctaaggtgcacatctttgagatgtgggaggaaaccagagtacctggagaaaacccatgcagacatggggagaaagtacaaactccacacacagtggcccggactgggaatccccccgcctttatttttcctcatcaacattataaaaaaa

SEQ ID NO: 403859 - DNA, 618 bp, Homo sapiens
gggatgttcattctaggccctttattacatagcaccctttgaattaaaagttagttgtttactgggtatatttttattgttactttctgattggcttttagtgtgtatttatgtgtgagtttcagagtagggatgtattgattcttaatagggacacttttaaaacattctagaaaaaacaaggggaaaaaagtacaccatagatgcagataggttgagatcacttacattggtaaatgtctctaagtctaaacgctaatactacaaaaaatcctttgcgtagcttccctctctctctgtctccctctttctctttcaatctctctctcagtggaagtccccagtgcaagttgcatgaataatggaaagcaatgatactaatgctactttgtacaaagtaaagcctcataacagtaactattgttcagtgatttaactagctccatggcagtaggtcattcaaatagcaattcttcccccaccagaatgactccattgctcaccattctgaaatatatagagtagttgttttatatagctattggtcctaacttagagacttgtattagaaaacatggagaatcttaaataatagaggaagaagagaagagaagggag

SEQ ID NO: 403860 - DNA, 558 bp, Homo sapiens
aaacctattgcactgccagttaaatacgagtataacacaattatatatagtatatgatacttaataacaaatgactatgtcactagtttatgtatttactatgctatttttctttattttaaagggtacgctttctacttaaaaaataaacttaaccgtaaaacaactttaggcaggtccttcagggaggtattccaaaagaaggcattgttacaggatatgacacctctatgtgtgttattgcctctcagcaactttcagtgggaggcccatgtggtggctcatacctgtaatccctgccctttcggaggccaaggtgggaggatcccttgaggcaggagttcaagaccagcctgggcaaggtagcaagaccctgtctctacgaatcaattttttaaaaaactagtcaggcatggtgacacatgcctgtagtcctagctacttggaagattgaggcaggagtatcacttgatcccaggagttccaggttgcagtgagctttagtcacgccactgcactccagtgtgtgtgacagagtgagaccctgtcaaaaaaaaa

SEQ ID NO: 403861 - DNA, 473 bp, Homo sapiens
attttatgaaaactttagtataacacactacttagtttggacttgaaatcaacttattatgatgcttaaaaaaatccatgttctaaatcataattgcatgacagtttagatcttattactatttagttgtagcctaacaaatactgtattcctctgttttctcaaaaaaaaaagttcctagtttatgaaatagtattcagataaagccttatgctgcccaccagcccactaaatgtattaaatacctgtctctatgtagcttatgtaaaaactcaatgttgactgtcccatgtctgctgcatttaaaagctcattgtgattctatcatcttgctatgccaatgccttatgttatggtgtcgtgtatataggccatggtacaaaagtgactgtcaactgcttactcaacatctagtcagaaaaggtctgaggcagtgcaataacgcttttagtcaaactggctcactgttggaa

SEQ ID NO: 403862 - DNA, 374 bp, Homo sapiens
gctattgggctttttctgggtagatactccttattagggatagagatcttcaaacatttttgcttattatactgatttaaaggattttgaaacatcatataccctcttgcatatttttgaagttgactttatatctaaaatttttcattgtaagtttaaattgttacaaagaatagacattctgggatatacaatatagtgacatttgaaaataaagctgttggctgggcccagtagctcacgcctgtaatcccagcactttgggaggccgaggcaggtggattgcttgagtttaggagtttgagatcagtctgggcaacatggtgaaaccctgtctctatttctaaaattttttttaaataaatttttttaaa

SEQ ID NO: 403863 - DNA, 473 bp, Homo sapiens
gcattcccagcctgtcctcctctcctctccgggctctcctctggggctccttctgctctccatcatatgttcatccagtcagtcagtccccagatccttaagtggctctgctaccagccaggtaccacactgaacacagagttcagcttcccaaaccagaggccccagctggaaacctcagaggtccccagctccttcaacctggtgagtcctacttgggccctcccatctgctctccaacccacctccacttacccagctcctccccataccatcccctacttccactccctctctctacctgcctcaggcttctcctcactccacgcaacccctgcctgcccagctgagcactcaagcccaccctgctggctgctgtggacccatctttagtctagctgccctgggccccgaggcttccccagccccactcctcactgctcaccccaccccacgccccatcatccagcaaa

SEQ ID NO: 403864 - DNA, 373 bp, Homo sapiens
acttcttgtgcccctttagaaccacacccacccctgccttccaactattaatgctggcaggacttagccagaccgcaagggcgcctactccgaacaaggaagagggtcaggcgctgggagggcgactgcaagcggacaggcagcacctgcgaccacggtacttggggacaccacaaaagtccgcagagcaggcatcccggcacttccgcgagcccgcaggccctgcccctttcgccgtcgccgaccaattgccgcccgaagaccgaacgcttcagcggagggccggaagtgagccgcagcttttcctttctgccaccgccttgtccaagatgcggacctccaccgccagctgcaggagtacctggcgcatggg

SEQ ID NO: 403865 - DNA, 1382 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403866 - DNA, 717 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggaaagagagagagagatctcttcttcctcctggta

SEQ ID NO: 403867 - DNA, 859 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctgtggatgattcaagagagagacaaacagaagccacgatgtcttctatgaacatcattcagacaccatcgtttctgctgcattctgtttgttcagagtcctaaatacagctcacattcagaggaaggggaattgggcttccccttttgatgaaagaagtataaagaatttgtggccatatgtaaaaccacaccaaccacatatgtatatttatcactggaataccttgaatccaagagggctcccagtgatttttgtctcctactttttatgtccttgcttagtttctccctgattgtatcagggttgcttgtataaccaatcgaatatggtagaagtttctcatttccaaggctaggtctttaacaaagactttgtggctttccatgtggttactctctatgttcttgggcaacttgctgtcatgaaagacagtttatgtgtcgtcagcagccttatgaagttccgtgtggttaagaactgagaccttctactaaccgccaagtcagtgagccatcttagtcttcagtcccagtcctgtcttcagatgactgcagccccagctgatatcttgacaaataagctgctcctggattcctgacactgagaaattttgtgagataataaattgtttattgttttaagctgtca

SEQ ID NO: 403868 - DNA, 1155 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403869 - DNA, 1033 bp, Homo sapiens
aaggagactaacagctgctgaccctcagaccacatagacaactgtctgcctagaatgtcagtttgtttctttcaagataacccgcatctggacttcccctagttgatgaatgaaggttaggtctacctggccaggtagacctaacaccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403870 - DNA, 1504 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttggatggagtctcgctctgtcgcccaggctggagtgcagtggcgtgatcttggctcgctgcgacctccacctcccgggttcaagcgattctcctgcctcagcctcctgagtagctgggattacaggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403871 - DNA, 1700 bp, Homo sapiens
aatgtttttgtttttgttcaataaatattctcttcttccttccgctttcccctttcgcccttggcagagaagcaaataattgagttaaaaccttgatttgtggcaatgtgaataaattatagctaattccaggaacttagctgcatcctaccttgacccattttttctactggactcttatattgctctatatgttttagctacacaggtttattaaacatggatacagatgaaaaacagacttgttatgttagaagttataagttgctcatgcattaagattttgacacacaggaagtttgaatgaatgagtgaaaaaggttccaagttattaaaatgttctggtacctgatttattcatttgccataccagtaattctaaggtgggtgaagctcctttacttcctgaagaaacaagttagtttcttaaactaagcattaaaagaaagctggaattatttgtttccagaagtgttagtagtcatgctaagttgcccttctttggctagattgtccaatttttttttaggcctgttttgtctatttttgtcaagatataaatgtttaattgctttaaaaaaactgtgtggttgcagaaaaaaattgtactgttatattgttgagatcaatgagacttttctgtatttactttttcagacattattttgaactcaggctcagtctcagagatttcttcaacatgtaattttctaatgtttcctttcctgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagctctgaaaatcgtgaagcagtgaatattttagaattatttttgaaacctctttcagaactgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtgtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403872 - DNA, 1641 bp, Homo sapiens
aatgtttttgtttttgttcaataaatattctcttcttccttccgctttcccctttcgcccttggcagagaagcaaataattgagttaaaaccttgatttgtggcaatgtgaataaattatagctaattccaggaacttagctgcatcctaccttgacccattttttctactggactcttatattgctctatatgttttagctacacaggtttattaaacatggatacagatgaaaaacagacttgttatgttagaagttataagttgctcatgcattaagattttgacacacaggaagtttgaatgaatgagtgaaaaaggttccaagttattaaaatgttctggtacctgatttattcatttgccataccagtaattctaaggtgggtgaagctcctttacttcctgaagaaacaagttagtttcttaaactaagcattaaaagaaagctggaattatttgtttccagaagtgttagtagtcatgctaagttgcccttctttggctagattgtccaatttttttttaggcctgttttgtctatttttgtcaagatataaatgtttaattgctttaaaaaaactgtgtggttgcagaaaaaaattgtactgttatattgttgagatcaatgagacttttctgtatttactttttcagacattattttgaactcaggctcagtctcagagatttcttcaacatgtaattttctaatgtttcctttcctgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagtgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtgtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403873 - DNA, 1221 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaaaggatttgacacgataagcctcatctgatggaagagaggaataaataattcacctatatgtgtttgaggttgtgacagacttataaaatctttttaaaaaataaagctataatttatattaa

SEQ ID NO: 403874 - DNA, 1615 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaacgcgttgctcgtttgaaaagaaaaaaaaaatggcgctcgtggccctaagcggggagctctgagcgccgctccctttaggggcgggtaatgcatgatcctcgcggaatgagctgctggggtgggcgcttgagctggggggaccggtgtctctcaccaaaggggggtgttccggtgggcccgcgtacggccctacccggacaggcccgggccctaagggcgccgagagggcgcggccccggaacgcgcgtggccgcggcgaggactagggccgcccgcggcagcggcggactggtggggtgcagctggcggcgacgcggccgctctgacatcggccgggaccggtggggctctccgccttg

SEQ ID NO: 403875 - DNA, 541 bp, Homo sapiens
  misc_feature (25)..(27): n is a, c, g, or t
  misc_feature (29)..(29): n is a, c, g, or t
ggcgcgggaggcgagaacgagagannngngcacgtcgcatgaccggcgcgggcagttttgcatggttttgtgcgtctttaaaaaaaaacgtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403876 - DNA, 1539 bp, Homo sapiens
aatgtttttgtttttgttcaataaatattctcttcttccttccgctttcccctttcgcccttggcagagaagcaaataattgagttaaaaccttgatttgtggcaatgtgaataaattatagctaattccaggaacttagctgcatcctaccttgacccattttttctactggactcttatattgctctatatgttttagctacacaggtttattaaacatggatacagatgaaaaacagacttgttatgttagaagttataagttgctcatgcattaagattttgacacacaggaagtttgaatgaatgagtgaaaaaggttccaagttattaaaatgttctggtacctgatttattcatttgccataccagtaattctaaggtgggtgaagctcctttacttcctgaagaaacaagttagtttcttaaactaagcattaaaagaaagctggaattatttgtttccagaagtgttagtagtcatgctaagttgcccttctttggctagattgtccaatttttttttaggcctgttttgtctatttttgtcaagatataaatgtttaattgctttaaaaaaactgtgtggttgcagaaaaaaattgtactgttatattgttgagatcaatgagacttttctgtatttactttttcagacattattttgaactcaggctcagtctcagagatttcttcaacatgtaattttctaatgtttcctttcctgcaaggaatgagacaatatattcttggaatattaaagtacttttgaagtaactcatacgttttctcccctcttccatttgtttagctattgagggtttgctttaaaacaaatttatgtagaaatatcagtactataatagtattgtgatactgtgtatttcttaagcatatgccaggaaggagagcattagttaggtgtccaaaaaacagccaacaaaacaaatcagctctgaaaatcgtgaagcagtgaatattttagaattatttttgaaacctctttcagaactgtttttagaccccgtggtaatttgctatgtaatttaatactagtttaggcactccatgtacagttggtatgtttccttttgaaagataataatctatttataataaaagtctgaatatttcaatctcggaattcctctttaaaacttgaatcagttttactattgctttttaaaatgttacctatttatatttgctttgtatatcaatgctacacttcttgttttgttttaggtgtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaaaggatttgacacgataagcctcatctgatggaagagaggaataaataattcacctatatgtgtttgaggttgtgacagacttataaaatctttttaaaaaataaagctataatttatattaa

SEQ ID NO: 403877 - DNA, 1256 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403878 - DNA, 1245 bp, Homo sapiens
  misc_feature (36)..(36): n is a, c, g, or t
gcggatgcggtaagtccatttccataagcacagcgnctttgactgcagcgactctcttattattccccgctacctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcacagagcactacaggatgcattcagtgggcttttctggcagcccagttaaccatttataagatttggaccttggagctgaaccagggagctagcaaaagtaaagcagacttataaaattatagctatgtgcagctgcacaacacagtccttccactagcagctgtgttaaagtatttataaggagaaaatttcagaactaagttgagtaatataggggatatatatttgtgaaaaataatttttacttatatttttcagaggatttgacacgataagcctcatctgatggaagagaggaataaataattcacctatatgtgtttgaggttgtgacagacttataaaatctttttaaaaaataaagctataatttatattaa

SEQ ID NO: 403879 - DNA, 1052 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttggaggatttgacacgataagcctcatctgatggaagagaggaataaataattcacctatatgtgtttgaggttgtgacagacttataaaatctttttaaaaaataaagctataatttatattaa

SEQ ID NO: 403880 - DNA, 1266 bp, Homo sapiens
cgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctccttgaagctgatggtgaatgtgtgcggacacactctctgtgaaagttgtgtagatttactgtttgtgagaggagctggaaactgccctgagtgtggtactccactcagaaagagcaacttcagggtacaactctttgaagatcccactgttgacaaggaggttgagatcaggaaaaaagtgctaaagatatacaataaaagggaagaagattttcctagtctaagagaatacaatgatttcttggaagaagtggaagaaattgttttcaacttgaccaacaatgtggatttggacaacaccaaaaagaaaatggagatataccaaaaggaaaacaaagatgttattcagaaaaataaattaaagctgactcgagaacaggaagaactggaagaagctttagaagtggaacgacaggaaaatgaacaaagaagattatttatacaaaaagaagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatgtgtcctaaagaactttacattgaggagctgatatgtgggacttattgctgttcttaactgacatgttaacatcttagattttcagtttatagaactttactgttttgtgaaaaatgaacagtactcaataccaaattgttttatttagtacattaatttttctgtggacttgttaggtctcttgagattgagcctggaatacattcgttcttttagaagtctgtccttggcagccatattgaaatggcgtttattttcagtcatgagtgtttttttcttttttaaagaaattggggcttaatttagttagtagtaagccaataaaaatatg

SEQ ID NO: 403881 - DNA, 205 bp, Homo sapiens
ctgagtggctcacctgagtgtccttcatggtttctgtgtaattcacctgtctctccctatcttctttgctcctagaggccccatcaccatagaaacaagggggtaagagtgggcttttgggctccactgtagcttgaactccgagggccccgcactcctcttgcttctctctgggatgcagaggcctgctctcctaggggccaga

SEQ ID NO: 403882 - DNA, 449 bp, Homo sapiens
tgagtagtgatcgagacactgcactccagcctgggtgacagagcaaaatcctgtctcaaaaaaaaaaaaaaaaaaagtcagaaaataaatgttacaacatggatgaacctttaaaacattgcataaatgaaagaagccagtcacaaaagacaatatatgattccattacacgaaatatccagaataggcaaatctatagagacacaaagtagattagtggttacctaaggctgggcgtggtgatagggagattgaagatgacagttgaagaacatagggtttctttttgaggtgataataatgttctaaaattgactgtagtgatacacgtaaaactctgtgaatatactaaaacccaccaaactgttcatttcaaatgaatggtgtgatatatgaattatatctcagtaaaattgttaccaaaagagttggtttttgtttttttaaaa

SEQ ID NO: 403883 - DNA, 567 bp, Homo sapiens
gtccaaaggccctgaggtgtgcatgtctcgtgtgttcaaggaatatccagggagcggagtccggggaaggaaagtaggagctgaggtgagaaagtgcgaggagagaaaaactttgctattttattggagcagagcacagcggcgtgtttatgtctaaaaagagtagaaattattctggatggtgactccacaaggggaacatatgcagcttgcctggtttcaagataagggccataatcagtggcacacaggagccggcacataccaacttgcaacagtcaaatgtttaggaatcttgagagccagttgataaacacagctattattaaaaattaaattctagatttataattaaataagttatatttaacagtattatatttaacagtatatatttaacagtagcagtatttagtacttagaaagtggcaaaagcaacaaattggggcttgatttattagttgttgtctagacttaagaaaatgatgacgaaaatgttaataatagagctttaacttagaattatgtcatacttggaaccattacattgcaaatagaaaaaaaaaa

SEQ ID NO: 403884 - DNA, 249 bp, Homo sapiens
gggttggctaaatgaattcagagacactcttgactcaggaaagagcaggtaaaagaatccatgagagctccagggaggtgtggtcagggcagcagagagcagattgctgggcttcaccgagcccacaggacaggctgtatggactccgctggacttgtttcaggtaaatatttgtccaaaaatgtgtacgtctggcagaatttgctctgaggctgctttcattcaaacttgataatgaggctggcttca

SEQ ID NO: 403885 - DNA, 577 bp, Homo sapiens
ttctcaggtccattcttaaccttctaagatgtaaaccttgaagactcaccaagcaaagaggtaccctaaaattgaagtcaggataaggaggacgactcagcttagagtcattgattgatctgcattgtgaaaattaggaaaccagatgctcccatgttctcaaggacagcctttcttaaggaagtcagtacgtgggcaacagtgatgagaggaagagaggagagactcaaccaactagagcagggataaggtttcccttgttcagcttttcagtgtctgctggaatgtgatgattacctcattgtcaggtaggaagtgaaacgtatgatattcttcctggcctttgccttgagagtcttctggagcctgaagagggtggggcagacaaccatggactgctagagaataaactttctttgaagcttcctaaatggattagaaagaaggggttctgtcaaagggaaagggtctatacagatgtgaccagcagtttgattagtttagatgtatgatttagtagccaatataagaaacttgtaatttttagtaattagaatttattataaataataaaaca

SEQ ID NO: 403886 - DNA, 466 bp, Homo sapiens
tttacccaaaaggtaatagaaagcctttgccttcatgttgacttggctttccttgcctagcacttggttgcttgcttgaaaatcatgtatgtatatatataaaatgtagaagcccaattcaaattaataatgtaaaaatttattctgttacacagattacctcattgtcaggtaggaagtgaaacgtatgatattcttcctggcctttgccttgagagtcttctggagcctgaagagggtggggcagacaaccatggactgctagagaataaactttctttgaagcttcctaaatggattagaaagaaggggttctgtcaaagggaaagggtctatacagatgtgaccagcagtttgattagtttagatgtatgatttagtagccaatataagaaacttgtaatttttagtaattagaatttattataaataataaaacagggtattaattattaatattatggta

SEQ ID NO: 403887 - DNA, 384 bp, Homo sapiens
gtacttggtagaaatatactgagaaaaatccaaggaagaggaaaaatgtatttttacatggtttgtgtttggttgagtaaaatttaaataaccaagaaatttaattttcacttttctcaattattacggtcatataaatgatgagagctaatgaacttcagtgatcagaggaaactattaacagtgataatataataatactgatttattctcacttgagttttttccttaaggtctgacaccatgccaatttccacagacctgtaactttaagttaccttaagctgggcctggtggctcacgcctgtaatacaagcactttgggaggccgaggtgggaggattgcttgagaccagcaacaacatagtcagaccacgtttctac

SEQ ID NO: 403888 - DNA, 368 bp, Homo sapiens
gttccatggactttgatgttcttgatattcattcttggtattggcattatgagttgtgacactaggaggagtctccaagtgactttgaaatgagaagacaggaacaaagaggtgtcatacatccctcacagatggtcagaaatatctaaagagtttttgccaaagagatagggtcctgaatgggcagcagggttaagagaaaaatgtgtagttattaatgttaatgagacatcctttgctacaagatgatggtgaggtctcaaggagatctaggttatatttacaagggatcactccaattactacatgtccgtcttttctaaaattagactttattgtgctctattaaaatagctttatctttagaa

SEQ ID NO: 403889 - DNA, 907 bp, Homo sapiens
tccaccctgtgctttctcgatgtgtccttactcggtgtttctgtggagcagggcatcctgggcttcctttctgatccctggctcctgtgatcttccgtgctgggctccctcttcccttcccttttccactgtgttgccctcacacagctggcatgccatggatgtcgctcacccaagcccttcctaatgttgctcaccaaaacccctcccaccttgcccctgggaccttctccccttccaggctgcatgcaggccgagggcctggcgtctcagcaggaggcagtggggcctttgctggcacctgggctctgcatcctgaccttctgagggcttggtcctttaggtccatcttgaatctcctccaggcttcggactctctgctctgtagctggcccatggagacgggtacactcaggcctggtcttagactccgctgcttgggctgtgctggtgcctttggtgccctcttagtccatcccacctgggggccctgtcctgctgtccattgtgccagagtgctgtccccttgtctttccgtaactggctgctcgttacctttcccatctcagcctcagtaccagccacttggtatcagggaggctctccctgaccaacctaaagttcacagccgtggttgccagtttaaatttctgcatagcaactttttggtttattttggctacttatcttccccatcatgccccctgtccctcccatataaactcagtgagagtaggggccacatctcatcatcctgcccacagctctgctgtctgtatcagccagggtatgctgtgcagaggctcacggtaaatagctgcagaccacgaatcccatctgcttgctgtgctttaatattggcttacatctttggatccagtgagttcttttctctgtctccctctct

SEQ ID NO: 403890 - DNA, 436 bp, Homo sapiens
gattaattcctcatagaacatctaaatggattggagagttggcaagggaaatgaagctcatcccagcaccttccttagtcactcacgcttagcactctgtcaagatctctgcctcatctgctagcataacatgtggattgcttgttggagcttatttccccgccccccatggtaaattctcatttcctgtgtacatgcacctggacttttttgtttttttaccaagagttgggaaaaatcccttctatgctatctatattctgcaaacaaattattattattattattattgagacagagtattattattattattattattattattattactgaggcaggagaatcgcttgaacccaggaggcggaggttgcagtgaggcgagatcacgccactacactccagcctggcgacagagcaagactctctcaaaaaa

SEQ ID NO: 403891 - DNA, 321 bp, Homo sapiens
catcaaattgtcattcccaacgttggaacaggggcctggtgggaggtaactgaatcataggaacagacttgctgttctcatggtagagttctctagagatctagttgtttagcacctctagagatctagagtgtgtagtacctttccattcactttctcactctctctctctctctctctcccgccgaccacgtgaagatttgcttgcttctcctttgccttcggccatgattgttaagtttcctgaggcctccccaggagcagaagcttgaacagcccataggaccatgaatctattaaacctcttttctttataaatta

SEQ ID NO: 403892 - DNA, 387 bp, Homo sapiens
tcaggggcatgtttccttggtgcctcccatcccaacctgcacctgtggcgactttgagactttccagcattgcacggagagcaggagtaggctttatggcttgttttacacacagtgtttttaatatcccagtcctgataaaatcagcgttttaggccaagaggaatgggggacaaacagactcgagcttccaacattcctaaccatgcattcagttgttttgcatatggttgctttatgtccattgtgtacttttaataagcagttaagatttttgctacattccaagggtgattaagagaggaaggaagggggatttttatcccaaagaatcagttatttcttttggtgtatctcattggcattctttataaactctacctaagt

SEQ ID NO: 403893 - DNA, 620 bp, Homo sapiens
tgtttttgggatgtactcaacatcatggattatgagggactgttgcaggaacaaaaacgtgcttaaagaaaactcatgaaagaagcaatagcttcccataagaatctgaagggctcttgtatgacagagggatgagatttgttctggagggtgtctgagataacagttaggacaaaacaaagaaaagtgagtgtaagaagataaataatggctagaaagaagaaaaaactctgaaaatgaaatggctgccataagagagataaaatttccttttactataggaattccagaatagctaaataattacttgtccatggtactttggagagaattcaagcattcaggtaaggatagaagtacttaataataataatatactaacactaataatgactaccatttaatgatcatcagtatgtgtcaagtcctgtgctgatggtttatataaattccacaaaatacttctgtgctctacaaatacaatttcagtcctcacagcaatttttaaacatgatcctcattataatggtaaaaactgctaatatttagtattccttctcaccttcttccttttagtaattgaattccctaattttagctatattcatgactgcccagct

SEQ ID NO: 403894 - DNA, 157 bp, Homo sapiens
ttgataagaccacagatcatttcttctactcttgtaaggttcttgattcgaactgaacttttctggaattctggcatcatctcgatgatcttggtcttccgccccgtcttcctcttcaaggtgaatatgtactgagccagcaccacccccgccacca

SEQ ID NO: 403895 - DNA, 682 bp, Homo sapiens
ctaatctcttgtcattattcaaatacaagagagtacttcttcatatataattcttagggaaattgtcaatttcccattttccctgaaaatctatttttatagaaaaatgtgggcccaactcactctttaaaaaattagatttggctttattggacattacataaacaaggataaaaaacgtccaaccaagcacttgactgaatttttcaccatttcgtcatttttgttattgtatagatggtctaaaaatcacattatgaccaaccaacaacttggctttggtgataattaagtatctgagaaaaatatggtagcccttatgacagactcaagcactaaaaatgggctacaatagaagagtgacttggggttctttatggggttcaagctcttcagcccatgtcttctttgggctgctcaactttctctggggtcaaatgaaagtcaagtttgggcaacagtgatcgttacagctctctttggctcccctaagactcagaagagcaatatatctacaagcggcttcttctctactctacaaattaagtggaaaggaaagaaatgctgtctgaattctcttttcctccactcaatgggcccttgcattctccttattccaccgacagccatgcaactacaggcagatcgtgtaaactctccaggtattatttcacttatctgt

SEQ ID NO: 403896 - DNA, 470 bp, Homo sapiens
gacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgaga

SEQ ID NO: 403897 - DNA, 253 bp, Homo sapiens
tttttttgtatttttagtatagacggtgtttcaccatgttagccaggatggtctcgatctcctgacctcgtgatctgcctgcctcggcctcccaaagtgctgggattacaggtgtgagccaccgcgcccagccttaggcaaagaattcttaaacttgacaacaaaagcaagatccataaaagggaaaattggtaaacagggtgtcatcaaattttttaaatttcagactttgaaagcccatgtgaaaagaatg

SEQ ID NO: 403898 - DNA, 737 bp, Homo sapiens
attaagggaaactgagtgaaggatgtgtagagctcctccacatgatctttataaatttgtgttgaagccatatctatttcaaaggaaaagtcgccaacatgtcatttcatggccattccacctttagagacttcccctttcagcaatttagggctacagaaagaaacagccatggcatctgcacacaacaaagaggttatttcaaacccaacttaaggccaggcttcaaccctataaagcaaccagtgccacagggaatgccctaaccctgaaaacactcatttgaggctctctggagaaaacaactcagaaatagggtagggtagagagggactaccctgaagtaccctccaaaaaaggagggaaggtaggaagaaaaaaaagatcctgagtacaggaagggaaacaaaaattgaaacagagatccacagtttgatccaattggaaaactaaaatttatctatgttttagcgtaatgttttaagcaaaaattctgataaaaggtctagtattgactcctgcacctctctctaggataggttctgaattcctggtgatcctactaaaattaaacaaagtaccccccataattttaggggagctcttgaacataaagagattacaaacaggtatgcctcaccttaagtattgaaatttccccatgctcaaaacacccatttccttaaaatataccatagtgggcatgggtgctctcatgcaatgagtaataaattaaa

SEQ ID NO: 403899 - DNA, 853 bp, Homo sapiens
ggcagtagttggaatgagtcagaaatagatggattgagcatataaaacttcctcccaagggtaggcttgcactgtgaggaggggtttcccttagtagccatgtctgattggtgtctgttttggtcaaaagaggctatgtaaggggaaaccaaatatttggggtacaggttactttctttgcttcaagaaagctctcagtatgtcctgaggaagtctcgcctatcctagggtagactgggaactctgaaggttatagggaagtagaaatgcctgtctctgcctgattcttttctgtttatcaacctcctctgggatcagtgagttcaatcttgtgaaataactgatctatcccatgcttatttatcatctgagagtagtaataaacacacttacccactagtagatacttaatttaatacttccagacattgtggctgttactgactgtatgaagataaaattaattaagggattctattctaaagtaatctgttgtataatgcagaacattacctgtgtgcaggagatactccatgtattgcatgaaaatgtgagaatgctaaaactaatttctagagagccaattgagaaagaaaaattggaaaataacattaagaaattattttaatatatttttgaagtctgggtaacatagcgagatcctatctctaccaaaaaatattttttaaattagccaagtgtggtggcacacctgtagccctggctactctggaggctgaagcaagaggatgacatgagcccgggaggtggaggctgcagtgagccatgcttgcgccattatactccagcctgggtgacagagcaagaccttgtttccaaaaaaaaaaaaaaa

SEQ ID NO: 403900 - DNA, 462 bp, Homo sapiens
ctgggatttatacggtgaaagaagacccaagacagaacactgaaaggggaggtatgaaggttaatggccaacaggagtggtgaatagatggccttcttttctagaatgagatttctttggtataaaataatcataactgattaaatgaaagtatttgatattattctggcatatatacagaagagactagaaaactagaaaatatcctacatgtgatatactttatgaagtttaaacagcacagagttctggcaaatgttactaatgatgaataaaatattttgttttctggtgcatgcctctaatcccagctactcaggaggctgaggcgggagaatcacttgaacccaggaggcgaaggttgcagtgagccaagatcacgccattgcactccagcctgggcaacaagagcgaaactccatctcaaaaactaaataaataaataaatttgttttcactgag

SEQ ID NO: 403901 - DNA, 480 bp, Homo sapiens
catgtcccatgaagtgccaaggccttggctacaggagggttagagtcaaatacgtacctttactggtcagctactgttcagacagaagcatctgccttctcagaatgttgctttctgttgctctgttcactgaaaagtaggggaattatctgtggatttgttctctctgaagatttctacaattaaaaaaaaacaagttgactgggcatggtgactcatgcctgtaatcccagcactttgggaggcctgaggtgggcagatcacgaggtcaagagtttgagaccagcctgaccaacatggtgaaaccccatctctactaaaaatacataaattagccgggtgtggtggcatgcgcctgtagtcccagctactcaggaggctgaggcaggagaatcactagaacctgggaggcgaaggttgcagtgagccgagatcgcgccactgcactcctgcctggagacagagcgagactccatctca

SEQ ID NO: 403902 - DNA, 1081 bp, Homo sapiens
ccgctggggttcctggaggaaaagcctgcaagaaaatgtgaacacctccatctgtggctctcagaggctcccacgctcaagcgagcccacacttgaccttgagcaatgtctacattttctggctgaatcccgcctgattctgaagtgtggggctggcacctgtcccagggaagccgcctcttcctacagtcacctgttttgctctaggtttcaggcgagttgtttctgctgcagccttattctgggatcaggagtgggcggttaactgatgtccgcccagccttttctgggtgaaagggtgggagggctgtttctcagctctccagccagggtccagagcctattttggaatggacatggtcattaaggtgtctgtgcatgaaggcccctgaagcccccggtactgctagtgcggcgggcatccgtggagggtcctggagaggtgggaccctccgatgcagtgctctgatcaggcaaatatttttgatgattattatttaaaaaggaattaattcagttagctaaatggcaagtgtttttttctttagtctacttacttgatagcctcagtgaactgaaattttaggaaactggcttgctttccttgcagttgctgtaatctgttgcatagtcttggtttttgtagtccttctggcagtctcactacatcttcccaggacaccctctccttagccagtgacctacccagcagggcaccagcagccttccagaaaggcctggcacttgaggctttctggtgagccgggggcacactggtcacagtttgtgcttccctctgctcagtggatggaggcacccacagttttagaagcactccacttccactggggtcagggcggtgctgatgtcagctgagtgcgtgtgcacgtgtttgtattttcttcatcactttaaaaccgtgcctgagctgtaaagtatctccatgtgagagaaccgaagagctgtgtgatgttgacagactttgtttctcattcttgtgcctcgacctctgcattacttctccaggatgaagaaagccaagacttgccctgtgttcctggcccccctcatgaagttccca

SEQ ID NO: 403903 - DNA, 2532 bp, Homo sapiens
  misc_feature (2)..(2): n is a, c, g, or t
  misc_feature (4)..(4): n is a, c, g, or t
  misc_feature (6)..(8): n is a, c, g, or t
  misc_feature (1688)..(1688): n is a, c, g, or t
gncncnnngcgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtcccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggantggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacagggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 403904 - DNA, 544 bp, Homo sapiens
tagactcgctaccaaaaacgtaaagaaagccctcttcggtgtgattgtttttcattatgggaagctcattcagataacgtggaagttgaacctgatgaaaagggaacttgaatgtcatgaaacacaggaagaatatgtccaaggttataagtatacactatattatagaggaatataaacaagaaaactagtaccttgagcagggaactacatggttcttagtaacagcatgctgttacttaccacagtaacttttctggttatatggaaaaattcagacatatcaagaaaagccaagagcacaaaattaagttatactggagaaaaacgctgcttttctacgccttcaagataaatattctaatgtcaggccaaaacagcaatgttagaaccaaaaaaagccaaagaggagaatgatcatctcaggccttctccaggggagaaaaaaatgaaggaaatgacatattgacctgcaaatcatgtacagcaagaaactgtaaaagatgaacttctgcaatatgaatttgagaaataaaaaaaaaaa

SEQ ID NO: 403905 - DNA, 616 bp, Homo sapiens
ggccacctccagcctggccgctcacccgagcaggggggccgctgcccaagaaccctttcctggagagctgctccgagaccgcacagcgccgccgcgtcttctccttttccactcctctctcctaatttttttgatttaccagcgttcgacatcgttatctcttcctctagattaattgcttcgctcttttgagcaagaatactctgtgtggcatctttggtactatggggaacgagaatccagcattatctttaataaaatccagaaacatttttggttgtttcctttgaggggtacgtcgcagcacgctcacttttttccccttctcgttggccttggtccttcagtttcacaaaatgtggatagtgacttaaaaataccttaaaaaaaaaaaaaagaaaaaaccattagagtaaggggaaagcacttcctaaagagttgaagaactaattggtcggtaaaaattggatattgaattcataagatgttaaaatggactggatttttggtagttttggttgcttttaaaaaaattagtgctagctttcaagtgaattacaaccttaaatttgagatttcctttggtgaaccatggaagtttacccagtggtaagga

SEQ ID NO: 403906 - DNA, 378 bp, Homo sapiens
tagaggttgcagtgagccgagatcacaccactgcactccagcctgggcgacagagcaagacttggcctcagagaaaaaaagaaaattgatattaatacttaaatgtttggtaggattcactagcagaaccatctgggcctggagttttgattgttggaaggtttttaatcatgaattcaattattttaataggtataggcttattagattatcagtttcttcttgagtgagttttagaggtttatgcctaaggcgttaatccattccactcggattgtcaaacttatggacataagtctattggttagtatttctctattagccttttattgtctgtagggcctgtagtgatgtgtctttttcattcctgatattggt

SEQ ID NO: 403907 - DNA, 545 bp, Homo sapiens
tccaattagaagacttgtttaatcaatatactcagccttttgtgataatggtaatggtttgtgggtagattagtaaccttgaaaacagaaaggaatagtggcttatactagtgactgtccagaaagacctagctgatcattaaatttttggaattgttgagaaggccagttttctttcattctaaacagttaacatagttaaggaacataggtaaggatacatttaaggaaatagaatgtttcaaatagcttaaaaaattctcttggccaactttttgatgaagttggtaaagtagcagtgtaagtccaagagcccaggcatatttactgtcatgattttcatagcaatgaataggtaaagaaaatacgagcactagaagctagaaaacatgccattttcatggcaaatattaatgttcttcagctaaatgttgtttggatgatgctggaacaagaaggctaactcatgacacctctgttgtgacagagcaacatgcctagggattgagtggagggaactctgaacagaatttgagttgtgcctt

SEQ ID NO: 403908 - DNA, 1293 bp, Homo sapiens
atggagggggagccctcccagcctcccaacagcagttggcccctaagtcagaatgggactaacactgaggccaccccggctacaaacctcaccttctcctcctactatcagcacacctcccctgtggcggccatgttcattgtggcctatgcgctcatcttcctgctctgcatggtgggcaacaccctggtctgtttcatcgtgctcaagaaccggcacatgcatactgtcaccaacatgttcatcctcaacctggctgtcagtgacctgctggtgggcatcttctgcatgcccaccacccttgtggacaacctcatcactgggtggcccttcgacaatgccacatgcaagatgagcggcttggtgcagggcatgtctgtgtcggcttccgttttcacactggtggccattgctgtggaaaggttccgctgcatcgtgcaccctttccgcgagaagctgaccctgcggaaggcgctcgtcaccatcgccgtcatctgggccctggcgctgctcatcatgtgtccctcggccgtcacgctgaccgtcacccgtgaggagcaccacttcatggtggacgcccgcaaccgctcctaccctctctactcctgctgggaggcctggcccgagaagggcatgcgcagggtctacaccactgtgctcttctcgcacatctacctggcgccgctggcgctcatcgtggtcatgtacgcccgcatcgcgcgcaagctctgccaggccccgggcccggcccccgggggcgaggaggctgcggacccgcgagcatcgcggcgcagagcgcgcgtggtgcacatgctggtcatggtggcgctgttcttcacgctgtcctggctgccgctctgggcgctgctgctgctcatcgactacgggcagctcagcgcgccgcagctgcacctggtcaccgtctacgccttccccttcgcgcactggctggccttcttcaacagcagcgccaaccccatcatctacggctacttcaacgagaacttccgccgcggcttccaggccgccttccgcgcccgcctctgcccgcgcccgtcggggagccacaaggaggcctactccgagcggcccggcgggcttctgcacaggcgggtcttcgtggtggtgcggcccagcgactccgggctgccctctgagtcgggccctagcagtggggcccccaggcccggccgcctcccgctgcggaatgggcgggtggctcaccacggcttgcccagggaagggcctggctgctcccacctgcccctcaccattccagcctgggatatctga

SEQ ID NO: 403909 - DNA, 407 bp, Homo sapiens
ctgttcccaacacagagacatggtcagtctcttcatttatttagttctccaataacgttcagggtgttagttttctctgtagaggttctctgtagagtacatcttggatttgtttctaggtacaggaaactttttaaaaatatattttatatagaccagggtctcaccacgttgctcaggctggtcttgaactcctggccttggcatcccaaagtgctgggattacagatgtgagctactgcacccagccaggaaatgtattttctattgctctcccacaactcccaccacatcttctccatctgcatgaaatcatattctctgtatggtatctgtaaagtcatatcttattctgagaaatgtccatttctgcatcaatactcatcgcatgtattctaaatatactt

SEQ ID NO: 403910 - DNA, 359 bp, Homo sapiens
tgtttggaattcccaacttattaattaaatgggcagattctatgtgtacaattccacagcaccgagaacactaaaagttggctcagtagtaatagtataatcatattctttttggtgttttttattataaaaataagttatgtttacctctgaccaagtcagtaagactcatatcacctaagtatttgttataaagcattaaagagcagggtgcagtggctcacgcctgtaatcacaggactttgggaggctggggcgggtggatcgcttgaggtcaggagttcaagcaatccacccaccttggcctcctaaagtgctaggatccaactttaccccttgccttctgaaggttctatgtt

SEQ ID NO: 403911 - DNA, 352 bp, Homo sapiens
cacacctcacaaagtgcaagactcaaaactgtgggatcgtaactttattctaaacttatttaaatctactttcctaaaatgtaagttatcttgactgcctccatgaaccctaaccatcacttgttatcatgctattacttcctgacccaaggtcccattctgctctcttttatctctgtcctgttggtttcagaggaatgatttaagcctaatttaattcttctattaatacttcagctctaacacttctgactgctccaactaattatcccatctcccagatttcccttactactagtttcttccttcatcctatacatatgctcaaatgttctcccatcctattaaaatg

SEQ ID NO: 403912 - DNA, 361 bp, Homo sapiens
atctcacagttctggggaccagaagtccaaaatccaggtgtctgcagggccatgcccctctgcaacctgtaggggaggatttttcctgccttttcctggctgctggtggcagccagccacccttggtggtcctggacctacagccacaggggccttcttatctctgtgtttctccttttttttgagacagtcccgctctgtcatccaggctggagtacagtggggcaatctcggctcactgcaacctccgcctcccgggttcaggcaattattctgcctcagccatccaagtagctgcaactgcaggcacctgtaatcgcagctacttggaaggccgaggtgggagaatcgcttgaacccg

SEQ ID NO: 403913 - DNA, 426 bp, Homo sapiens
ggcttcatggagctttgccctaactgtgtatggcttagtattcagtcaaacacttgaggagaaccttgcgcagatttctgtaaagttttctctgtatagctccctcctctctggcacgctggccaataaattccagctaccttagcctccctgtgttagtcagggctcaccagagaaaccaaaccaataggatatacagagatatataaaagtatatttattatgggaattgggtcacacaattttggaggccaagaagtcccgtgatatgctgcctgaaagctggagaaccaggaaagccagcagcatagttcagtctgaatccaaaggcctgagaatggcgtgaacccgggaggtggagcttgcagtgagctgagactgcaccactgcactccagcctgggtgacagagcgagactccatcacc

SEQ ID NO: 403914 - DNA, 344 bp, Homo sapiens
tcctccaaacaaataaataaataaaaagaaagaaaaaaagaaacgacccagactatcagccctcccagagggggcctgggatgggctcatcggccttcctcacacagaaccctgcccgtccacccggactggggaggggctcgccccacctgagatgtccatgaagtcattcaggcttggctgcagtggcgtcaggtccggctggatcatgtcagcattggcgacgtaggctggaggcagcagtggcgacatcagcagcagcaggcagggagtcgcaggtcgcctggttctaggaataatgggggaagtatgtaggagttgaagattagtccaccgtagtcggt

SEQ ID NO: 403915 - DNA, 245 bp, Homo sapiens
caaatcctccaatggaacctggcctaggaagttcccagggagtgctacttggggagagaataaagagatggaatgaaaatactgaactgtaacatataagatggggatggggtgatgactgtaacctagtctttccataggacgatggtagaaatactcatttgagaaagtcaggcattcatcttaaaaacattgagaaagccactgaaaattcagaactagaatgtagaacatctaaaccagac

SEQ ID NO: 403916 - DNA, 648 bp, Homo sapiens
tgatgcctatatttagaggaagagctgtctaagcagagggaatccaaatacaatagccctggagtgggaaattccccagcatgtttcagaaatagaaagcaggccaacattgttggaatagagagtaggtggggagaggcaaaggtgggaggagttaaagtcaagtcaaaggtaacaaaatgtgaagctgatatgtgaagcttgaaatatctcctgcagattgagagggacactaataaagtgtcttttctaatgacctgccagattacagaagtggaagatgaggtcatggaaagcttctcagacataagggagctaaaatcatttatgttttaaagaagcattctcggccgggcgcggcggctcacgcctgtaatcccagcactttgggaggccgaggctgctgggaggccgaggcgggcagatcacgagttgaggagatcgagaccatcctggctaatgcggtgaaaccccgtctctattaaaaatacaaaaaaattagccgggcgtggtggcgggcgcctgtagtcccagctactccggaggctgaggtaggagaatggcgtgaacccgggaggcggagcttgccgtgattcgagatcgcgccagtgcactccagcctgggcgacagagcaagactccatctca

SEQ ID NO: 403917 - DNA, 201 bp, Homo sapiens
tggattggatcgggcccacctacattagggagggcaatctgtgtactcaaaattcaccaatttcaatgttgatctcaccaaaaacagccttacagaaatgcctagaataatgtttgaacaaatatctgggcactccatggcccagtcaaattggcacctaaaattaaccatcacacacaatgactaaaaaaaaaagttaaa

SEQ ID NO: 403918 - DNA, 239 bp, Homo sapiens
catcctgtcatatggtatttaattcacattgcgtagaagaaatgttcttggttttcttaggtgatctctaggttgtttcttctttcaaatgggtccaactttaaaataatgtagttatcagtattagtccagctgcagtgcattcttatctgccagtattctgcacgcttgcatatatgtacgtgtcatccacatgccagatgtaactgtcctcacagttgttcatgtgctgggcatgt

SEQ ID NO: 403919 - DNA, 835 bp, Homo sapiens
gatgaattataaacaacctattgatcaaaggagaaattacaaagaaaaatttttgagatatatatttttcaaactgtaagtgaaaaaaatatgaatttttaaaacagtgaaatatatatattcaaaaatttttaatagtttaatagcacaggagtgttactacagttaagaatttattgtatattttaaaacagctagaagatttaaaatgttcccaatacaaataaatgacaaatggttaaggagatggacatactcaataccctgatttgatcattacacattgtatgtatatatcaaaatatcacatctacacataaatatgtacagttattacataccaataaaaatgtaaaaatcttggcagagtacagtggctcactcctgtaattacagcacttcaagaggctgacgtgggaggatcacttgaggcaggagttcaagacccgcctggccaacatggtgaaacctcgtctccattaaaaatacaaaaattagctgggtgtggtggtgtgtgcctgtagtcccagctatgtgggaggctgagacatgagaatcacttgaacccaagaggcagaatccaaaatgttgtgattacaggcatgagccaccgtgcccggccgcccctactcttttgacctcatttaactttaattgcctcctgaaagccttatatttaaatgcagtcacattgtgaattagggcttcaacatgtaaattttggatgaaacacaatccagtccgtagcactttctcttcactagtgggcattcattccatttacaaatcttaaaaaaaaatgtgggggattttattgctgatgaaagtggctctc

SEQ ID NO: 403920 - DNA, 300 bp, Homo sapiens
accttgtcattacctttcagggagtagccccattacctctacctctgtacctctctcacctcccatctctgtgcccccatcactcccaagctctgtcctccccattaccttctacatctggccctcttcacattttatttcatctcatgtcagccccatcactttccacctcagtccctccacgttccatctcaggacttctgtcacttgcatcccagggacctcctcacctcccattttagtctattcatcacttcccatctctgcaccttgtcattacctttcagagggtagccccat

SEQ ID NO: 403921 - DNA, 635 bp, Homo sapiens
cttgcctcaaatctacttattgatattcacgtgtgcttccttgaaactcacataatctcaggacagctttctcattatctacaatctctattcaaattatctttttcttccaatccttcatggcatatgtctcacaacccatgaaccgtctttctcttcttatttgataccattattttaaatgatcacttctattattttcaaccctaaagctggtattaacttttatttatgctctcctgtggcatatgaattaatgacaaatagcaccgtaaatgaaactatatgctataagacatcaaaatagaatttgaacagataactaaataagctcattccacagtattttctttgataaaccaaagcttgatctcagtattctactgaatttctttaatgatcatatcttctcccctcctggacccttagagtcaaaatatgtctgaatgttcacccaaaaatctgacctgtcaacataaataacgtttcaaatcttcatggatgtttaatttctttttaagtgggggagataattatatgggagcttgctctaaaatttctgaattctagcagattgccttggctaacagcaccagcagtcatcttctaggctactgaaacagcataagaaaaaa

SEQ ID NO: 403922 - DNA, 450 bp, Homo sapiens
ttttttttcatttccagaaattgaatgtatttgggtgtattctatttagggtttgctctgtttcttgaatatttaggtttatgtcttccatctaatttgggaaggttgaagtcattattttttaatagttttttagtcccacattctatctcctcgtcttctatatctcctgtgattatgaatgttagctcttttattattgttctaaagtttcctgaaatgctgttaaatttttttttatcggttttcttcttcttgttcagacagtaaattctgttggcatgttttcagattcactgattccatcttctgctctgtgctctcttcttttgtgaccatcctctgcatctattatttccattattgtattttaattttatttggttcatgtttactttttataacttataagtcattattgaatttatttttaattttaacttttatgtc

SEQ ID NO: 403923 - DNA, 457 bp, Homo sapiens
ttttttttcatttccagaaattgaatgtatttgggtgtattctatttagggtttgctctgtttcttgaatatttaggtttatgtcttccatctaatttgggaaggttgaagtcattattttttaatagttttttagtcccacattctatctcctcgtcttctatatctcctgtgattatgaatgttagctcttttattattgttctaaagtttcctgaaatgctgttaaatttttttttatcggttttcttcttcttgttcagacagtaaattctgttggcatgttttcagattcactgattccatcttctgctctgtgctctcttcttttgtgaccatcctctgcatctattatttccattattgtattttaatttttgcttcaactattagaaatggcttaaaaacttaagagaagtttgattatacattatatttatgcttaatttttacccat

SEQ ID NO: 403924 - DNA, 398 bp, Homo sapiens
cattcctaagaggctcttggagtgactgagagatctgtgacacctgaatgattcacacctgcagtttctaggaaccccttctccatacactccatggttgtcaaataatcatatatttattgaacctgtactgtgcacaaagcactgtgctaggtatgtgacaccagggatagattctttgctccaagaagctcatgatgaagataaaacaactgtatgaagagaaaaaagaatcatccagggtagtttatgctagatgccagatgaatctaaagataaagagtagaggctttcagaaggggagagatgactgtgatgggagagttgggagccttcggggaagatgtatggttcaaagtgggttttcaagaagatgtgggtctcaagtaaagaaagga

SEQ ID NO: 403925 - DNA, 127 bp, Homo sapiens
cattctcctcctcctcctcttcatctctcttttcccttttctcctcctcttcctcctcttctattttaaaggaaatttcagatatcctaaatttttgccagcaaatacatctcaatgcctgtctcta

SEQ ID NO: 403926 - DNA, 546 bp, Homo sapiens
tgcattgcttatatatgactttgtatggagctctctaaacttaaccccctttctttcactcattcaaacaactgcttttataattttggataacatgaattcttaaaaacatacttatgctatatcaaataagactgtcctatagggtcaccagtgtgtgtatccccgaagccaacagtactcctacctacatagttgcggctctagcaacagaagtcaggtgtcaggactgcaaaatgcacatgacagaaataaagacatgagtgactatgactgccaaaggaatctggattgtttccttcaccacagtgttcttccatagtgagaccctgaaaataataggctgggggagggtagaagataacaaacagatttgcaagtccttcacctataatgagaatggataattcaattatatgccagaagaaaaagcacaaccccgttcagtattaattgtgctggaacttccaccataagtctgggtccagtcaatggggtaatttccaatatcccaaaagaactaagattgataaccaaaaggaaaat

SEQ ID NO: 403927 - DNA, 424 bp, Homo sapiens
ctgggcacagtggctcatgcctgtaatcccagcactttgggaggccgaggcgggtggatcacctgaggtcaggcgttcaagaccagcctggccaacatggtgaaaccttgtctcgactaaaaatacaaaaatttgtattccagctactcaaggggccaaggtgggagaatcacttgaacctgggaggtggaggttacagtgagccaaaatcatgccattgcactccagtctgggtgagagagcaagacttcgtttcaaaaaaaagagaaaagaaaagaaaagaatgcctcagctgaaccttatcaataaaagatgtagattatttgtttgagtactttaaggaagaatttgccatttcctgggagtacactgtttccaagtgatttattgattacctatgaacagttcattaaagggctctgga

SEQ ID NO: 403928 - DNA, 481 bp, Homo sapiens
aaggggtgaaggccaggaaagaacaatcaaagctggaggcggagaaccaggaaagataattatgtcaaggatataactgaagaagtagggaatggccaacacaagtaaaataacgaccaaaacctgcccattggttctagcaattaggaacttgaaccttacccctagatatacctgggaattgtcagggacagaaggcagatcacatggcattgagaaaatgcagagatatcaaaaagctatgaactaaaagagatactaagcaaaagactgaccaaggaagatttttagaaagcagattgagttcttcgttcatccattcaatacactgagtgccttcaatgtgccagtagttctaggtgcaagaatcaataaacaaaacatagattcttctttcattgagcttattttcttgtgagagtaggcaattagcaaatattttatgacaaatgatgatgagtgttgtgagaaaaaaatagta

SEQ ID NO: 403929 - DNA, 398 bp, Homo sapiens
aactaatcaacttcatgtcagagcacataaaaatgtaaaagataaattccaagaaaaagaaaacatttcaaaattaatataagaagaaatggaaaatcaaaagaatatttaagaaactaaatatgtaattaaaaaccttcccataaataaaaatcctggccatgattttgttgaatttttccgaaaaacagaagagaaagaaaacactttaaactctttttatgaggctggcatatctttgataacaaaccctaatgaaaatgtcacaaggaaaccacagacccagatctctcatgagcacaggtgcaaaacaaacaaaatactcacttatcaaatcagactagatatgatgaccaagttaggtttatctcaggaatgcaagactggcttacacattc

SEQ ID NO: 403930 - DNA, 296 bp, Homo sapiens
cacgatattaagtttcttcctttgcgaaggatgcagagcaaagcagtcaacagccctccctccacacctggctttggcctgggactcttcctcccagtccccagccaagttccctttcaggattaagaaaatacaccaaatgagggagccaatgacagcctgtaaggcaggacaaatcctcagctctcatcgtgacttctcaaagcaaacttgctccgcggaggggagagggaaaatcatttactttaaggtgctatagaaaactggtcatcgggactgtggggagtctccctgaa

SEQ ID NO: 403931 - DNA, 577 bp, Homo sapiens
cggcacgaggccaggcaggaagcagccacttggtggggttggggtatgagtccttcctcgcgggggctcggtgggtcctgagtattctttggccggatttgctgatccgtctgctccagcataggttcacaaagtacagtccgcaggccagcagcatcatctgggaacttaggaaaaaaccagccctactgagtcagaaactggggatgtggcccaggcaatcttttaccaagacctccaggtgattataatgcaaggaaggattccctatcttggacctgaggctgctttcttgaagaaaacttgactttatttcatttagtgggaagagcagcagcccagctattaagttctaatatgcaataggctgcaggctgtgaagtgttcgtggcagtagactctgaagctaaggagctgagggcttaacaagtttctagaagctgccatcaacatgccaagtcagtaaaactgatagttgatcagatttcaaggtctggggagtatatccactgtgtactgggtcttgagctctagagagctaggccttgctaaaataaaagaattaccttacctacca

SEQ ID NO: 403932 - DNA, 1207 bp, Homo sapiens
aggcttttaaagagcatggaattgtagatttaaagaatggcagttatagcaaaaacctccttttcctccccaattgcctaatcaacatttagggccccctccactcacccgacctcaacaccttatattttatagagtaaatgtttatgttagtaaggtcagaagaaaaattgggtcattgttgagaaaagagggtaccacccttcttttgggggactggtcctcttcaagcttattataaaggtggtgtgatggggatgaaatctctacaagggactcacagtagaaattctggctttctggaaatctttcaaatgccatccctgtcacatggcatctattcccttctcatcgttaccaactccttttgaagctctggggctctagccacaccaggctgccctgtggctggcttctgccataagggcaggaacagaattgaagtgtgcgactgccatatcatttgctttaaaggaaaatgtcctggacttattctcttttctgttcctgagtccagcaggagtgtggctagagcaggccccagatttgacctcgaaggcaaggatgacgccttgtgggatgagcaagtaataggatgaaaggaacctgggttcctctgtcgcaccagcctggattgctcatttcagaattgggcaggagggacccctttccttagtctattcttgtgtccagcaactgtaacttaattccatcagctctaaatgttgccacaacttcatagaagttaaagtattttcatatatagtaatccatataaccactgcagttattttaggggtagacaggagtcttatttcagaagcccctcctaggtggagcctggtgactattaggccaggactctaccctggcggcttctcctctctccaccacccattcaggagcgttgagctgctgtgcaatggactgagctgttccaggtagtagtgagttctctgtgcctggaggtatcaaatataggctggggatgtcacaggaagaatctaagcactgcaaagaaagtgatagtgacttcgattcatcaagcttcccaattctgaattagggccctcaacggttccctattagaatttagtaaatttgaggtcgcctaaaagtaaaatgccgggccgaaaaattggggagaccataaactctggggggcccccccgtctttaacaaaacatggagggctccgtctgttgtg

SEQ ID NO: 403933 - DNA, 1375 bp, Homo sapiens
aggcttttaaagagcatggaattgtagatttaaagaatggcagttatagcaaaaacctccttttcctccccaattgcctaatcaacatttagggccccctccactcacccgacctcaacaccttatattttatagagtaaatgtttatgttagtaaggtcagaagaaaaattgggtcattgttgagaaaagagggtaccacccttcttttgggggactggtcctcttcaagcttattataaaggtggtgtgatggggatgaaatctctacaagggactcacagtagaaattctggctttctggaaatctttcaaatgccatccctgtcacatggcatctattcccttctcatcgttaccaactccttttgaagctctggggctctagccacaccaggctgccctgtggctggcttctgccataagggcaggaacagaattgaagtgtgcgactgccatatcatttgctttaaaggaaaatgtcctggacttattctcttttctgttcctgagtccagcaggagtgtggctagagcaggccccagatttgacctcgaaggcaaggatgacgccttgtgggatgagcaagtaataggatgaaaggaacctgggttcctctgtcgcaccagcctggattgctcatttcagaattgggcaggagggacccctttccttagtctattcttgtgtccagcaactgtaacttaattccatcagctctaaatgttgccacaacttcatagaagttaaagtattttcatatatagtaatccatataaccactgcagttattttaggggtagacaggagtcttatttcagaagcccctcctaggtggagcctggtgactattaggccaggactctaccctggcggcttctcctctctccaccacccattcaggagcgttgagctgctgtgcaatggactgagctgttccaggtagtagtgagttctctgtgcctggaggtatcaaatataggctggggatgtcacaggaagaatctaagcactgcaaagaaagtgtgattagttgatccttcgtatcatttcaaagctttccccaaattctttgaattttagggcctcttctaaactgtttttctccctgaactttagaagtaatatttagaagtaaataatatatctgaaggagttcactgctatgaagaagatgtaaaataaaaataaagcccctaggcccccaagcaaaacaaaacagactcattgtggtaaaaagagaccccaggaaacattaaaaaccagattctacagctttggcaaggcaagaggtcagtcacacccaacgctctcccacctcgataactgcctcaagactttctttcctaaaattaaactaaaaccagttactgaaa

SEQ ID NO: 403934 - DNA, 539 bp, Homo sapiens
gagcttaggacagcgccgggctcaagagatgtggctaccttccctcctgctttcggtactcagcgcaggcagggttcagtgcagcaagtaacagctgtggcttactggattgtctgcaaccattggcgactgagagatccctgcagccctcccagaccctcgatctgactggagccaggcccacgtggggaaagggttaaacgttggcagtgacttcacccctgcattggagcaggcggaggcagagaacctgctggaagctgttctgaaccagagaaggatgaaaatagctgccaaagatgttgccatagcaactgctttccttcctgacctccttggaagtgaactccctcattttccagagtagtcaaggaatttctgtgcctctacccatggctttggttaccaactcatccctgggggccttggtttctttctgtgaaatggaatattcattccagcactcaccaccttctaggctggagtaaggctccaactttgcaaatgctgttagtaaactgtagagctccgtgcacttc

SEQ ID NO: 403935 - DNA, 1019 bp, Homo sapiens
aaaccattcacaacaaatggaccttcagttttaagtaacactgtactggcttttagggtaatgctcatataacccagtgttcagcattcctccctcctgcccaatttaacatcaccgtcatccatttgccctattataaactataaccacccaatacattgttattattttttgaacaaacctttatgatatccaataggaataagatatgcatatgtgtatatttgtgtgtgtgtgtgtgtgtgtgtgtgtgtgtgtatgatctgaatttctaacctgtaacatttttcttctctctgatgaacttcttttaacattattggcaagacaagtacaccaatcacatgttctctcaatttcattcctttttttccccattagattaatttcaattcatttatcatcattttaactgattttttttttggctgctcacatctgttgaacacttgtgaagatgtcttcattttagttgtaccttgcagctgcataaattctatatggctaaatttctacccctttttttttgagacagaggttcgctcttgttgcccaggctgaagtgcagtggcacgatctcggctcactgcaacctccacatcctgggttcaagcgattcttctgcctcagcctcccaagtagctgggattacaggcgtgcaccaccatgcccagctaattttgtatgtttagtagagatagggtttcaccacattggccaggctggtctcaaactcctggcctcaggtgatccacacaccttggcctcccaaagtgctgggattataggtgtgagccaccacgcccagttaatttctactttttaatagatattattttatctctgtatctatattctggttttcttttagttatttgttcatcattgcctttacttcattgaacatatttaagatagttgttttaacgtttttattcagtgagtggtgtctgaggtttctcagagatggcttatctcaattatattttttccaattgatgaaccatattttcatgttt

SEQ ID NO: 403936 - DNA, 496 bp, Homo sapiens
aagaagggaagatggagcctccgttttgaacatacctggctcccaggtagcccttttctgttggcacagctgctggcattcacccgtgcaagcttccagcttgcttgtctatgtttgcagctcgatttttcaggctgctctttgttagaaaagaataacttcttgggctactttttgttagaaaggaagccttgccaaggactcttctaccctcactatctgcctaatttctttctatctcctgtatcaaaaaggtgaaagttcttgatttgataaggaaagaaaaaaaatccatatgctgaggttgctatgttctctggtaaggacgaatctgctgggtgtgatggtgctcgcctgcagtcccagacactcaggaggctgaggcgggaggatcccttctgcccaggagttcaggtccaacagacaacattgagaccccatgtctggaaagaagtaaataaatgaaataacaaaagaaactctgggacctagacta

SEQ ID NO: 403937 - DNA, 1097 bp, Homo sapiens
gatttcaattagcacttacaggtatgagtctcatttgttttttagtttacctctttttaaagagagaaaacctacctttcttgtaatatctcacttctaacttggagctagtactctgaaagaattaattagcagttcgtttaaaatgtttttatttttcatggatggaggactatcatttgtcactttattcccccctcccacttcctatttataccatttataacctaatgttcagtaatattggaaaaatattctaggaaatgcattgtgggtaaaatggtggcttttcctcttctctcgtctgtttctgcccatcccccatttaaatcactcaaataaatcaatagtttattaacagtattcctttcctctctgagtgggtattaacaagattagcattaatgggaattaaattggtttagagaggaacacatatgcacgaaatatataaaacatttataattagcctgtcagcaacattttattagaagtttaaacccaagaggaaaaatgtcttctatttcatggaagttttctttatctgccaaaatttaaacgacagacactctaaaataatattctttttcttctttaatgttgtcaatcaaaagaaactaaagtgttttaaaatatgcagtacaattgtacatttacatagctgctgcattaggtgatgtaatatttcttgagaagcttaacacaggattaaaatgaaggaaaaaatattttaagtgttagatattttgtcattgctccaaatctttggatttatctgttaatatcccatttatagaagttaagtaaaccccaaatccaggtcaccttttttcagttgatttccttcatgtctatgctctcaatttcccagtgccacagactgtttttattctacttgaatcactagctgcaacaagatactcattttaaactcttgtcatcatttctcttagctcattttgtttgtacaactgattcttttgtaagtgtttgcttggcattatgcaaaagtggcttgcacaaagaaacaattgcattctgcaaccttcatttttttaatgtgaaagaaataaaagaacagaattgaatgcaaagga

SEQ ID NO: 403938 - DNA, 451 bp, Homo sapiens
ccagcaaggtgaccctcacaacagactctggaatcagcacaccgaagccagaaaaaagaggcacacctccccaagatgggctctgtggaggctaatggtagaaaccaggctccagagaccaaagggaagctggtatttggttatctccagaatcaactgccatcatgtattcagcagacagcagcgccctgtgtcgtctacctgcactgtatcacatcactctctaggtcatttggctcacaaaattgatttaggagagattattcaattccattttacattttcatgttttggaactctgccagcagcaacttctgttcttccagaggtcaggaagctatggacaaggcatctcttgctgttgtaaacggaactccatattccctttatgaatttcctgtcaatcttcaaattacttcaaatacgattgcccttcacttaaacaatgttt

SEQ ID NO: 403939 - DNA, 523 bp, Homo sapiens
ggaatacatcctgctcagtacctgctcctatagctccttgaagttctgtccatcgaaaaataaggatccatttaccagtatatagaggataactcgcagacgccatacatccaccagctcatatttgtggccctagaagaattccagggcagcctaaggggactgccacaaaaggtatccagcttgttgcgaaaggcgaatttattcctgaacccaatctgtgatgttcatgttaacatggacaatacatttctggtgacaatacacaatatctgtggacaatgcacttctggtaacagcttgcatagcagacacttttggtggaatttgcttcaggcctctttcctgctgctgtgagcaggtattcacaaacttctcgctagcgtgctttgtgatgaggcagagattcctcactatcgatcacagcaaatacttcactatgttggggtgatctgagccttcatgattcctactttgtggatggtgtctggaggctggaggagatctgctgagtctcatcaat

SEQ ID NO: 403940 - DNA, 710 bp, Homo sapiens
atgattactaatgatttattgttctttttttttattgttctaaaagtgctctgatgtggtgccttgatgtctaatgaaaagaaattggtcttaaaaagctactcattgtttatcctgactctgagataacacatttttcttctgataaaatatttttcttatttattgttcaaaacacacaatatagacaataactctaattctggtgcagttttatttagtagtgttttatccccggtgcctggctgtctacagtcatacctcagcacatagctttactctgagataagccctctctcctttgctctttctcccatgctttctggagtttgtctgcaggatgcaggttttgaactgaagagcgcagtggagttcttactgtgcctttccggttccagcacaatcaaagttttgtgtttggaattgtccttgacattctttcgtcccacaatggggtggacacagtgtgctggaaaccatgacatcattatcattgacacagacttaaataaatcacctgcatcttggcctctttctgcttattcaaggattcttcatcttaaggaagaaagtgctctttatttttacaaatcttcatcccaggggtgactggaagacgcaaacttttacaagtgtcttagagaatgtttaaggttagacataaggcagaaagacagccagattgcctttaattcggaggcaatattcct

SEQ ID NO: 403941 - DNA, 653 bp, Homo sapiens
atctcagtacatctatagcaagtgaagaggccgagttagtcccttagaaacctcccagtggccggccaccgtgcccagcccaatttttgtatttttagtagagacgggttcaccatgttggccaggctagtcttgaactcctgacctcaggtgatctgcctacctcagcctcccagtgtgagccaccgcacccagcctggattgttgaattcaatgcttgggtcacctccaaattcattttcacagtctttcatgttttggtcatactacattgtattttgctgccatatgactgatctttttttgttaaatgtgagatactttttaaaaaatatttaacaatgcattgaggcctagtagcatgttatcttgctgcagaagagatgggagtctacttctgggggatggtcaggggtcctccgtacaggctgcaattgaggtcgtctctgcaggctcagtccctacaaaggccagggtatttcctgtccacctctattctgatgcatgactcttctgggtctcaaccagagccagtggacttcagtatggatcgctttcattggcagaccctcaatccacttgttttccatctaaccccacgcatgtgtgcaaaagctgctgtgcttctttgcatctcagtagttccttctgga

SEQ ID NO: 403942 - DNA, 500 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 403943 - DNA, 573 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 403944 - DNA, 393 bp, Homo sapiens
ctaagacaaactcagaccatctcttttcggtctgaaaaaataatccgtttaattgaaaaacctggaggatactattccactcccccagatgaggaggctgaggagaccagacccctacatcacctcgtagccacttctgatactcttcacgaggcagcaggcaaagacaattcccaaaacctcgacaaaagcaattccaagggctgctgcagctaccaccagcacatttttcctcagccagcccccaatcttctccacacagccctccttatggatcgccttctcgttgaaattaatcccacagcccacagtaacattaatgcagcaggagtcggggactcggttcttcgacatggaagggattttctcccaatctgtgtagttagcagcccc

SEQ ID NO: 403945 - DNA, 335 bp, Homo sapiens
ctaagacaaactcagaccatctcttttcggtctgaaaaaataatccgtttaattgaaaaacctggaggatactattccactcccccagatgaggaggctgaggagaccagacccctacatcacctcgtagccacttctgatactcttcacgaggcagcaggcaaagacaattcccaaaaccagcccccaatcttctccacacagccctccttatggatcgccttctcgttgaaattaatcccacagcccacagtaacattaatgcagcaggagtcggggactcggttcttcgacatggaagggattttctcccaatctgtgtagttagcagcccc

SEQ ID NO: 403946 - DNA, 419 bp, Homo sapiens
  misc_feature (260)..(260): n is a, c, g, or t
ctaagacaaactcagaccatctcttttcggtctgaaaaaataatccgtttaattgaaaaacctggaggatactattccactcccccagatgaggaggctgaggagaccagacccctacatcacctcgtagccacttctgatactcttcacgaggcagcaggcaaagacaattcccaaaacctcgacaaaagcaattccaagggctgctgcagctaccaccagcacatttttcctcagcaaaaaagaaaaaaaaaaaaaanaaagacgaaaataacaagacaaaaacgcccgggggctcatattggaggggggggcggaaacaaagggggtaaaaaaggggcacaagggtccacagagggggccgaagccactttttggttacacaaaggggggaaaaacggggggcccccctaaaagga

SEQ ID NO: 403947 - DNA, 139 bp, Homo sapiens
gggcagactgcagctgccctttgtagacatattccagtgcagtggcaatggtgcgcatgtccagccctatccctcctacctcacccgcagggggaaggagggaggctgacaagccttgaataaaacacaagcctccgtt

SEQ ID NO: 403948 - DNA, 754 bp, Homo sapiens
  misc_feature (595)..(595): n is a, c, g, or t
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaaaagaaaaaaaaaaaaaanaaagacgaaaataacaagacaaaaacgcccgggggctcatattggaggggggggcggaaacaaagggggtaaaaaaggggcacaagggtccacagagggggccgaagccactttttggttacacaaaggggggaaaaacggggggcccccctaaaagga

SEQ ID NO: 403949 - DNA, 764 bp, Homo sapiens
gtgtatatcttccactttattggcagttgacattcccttactcacaagtaacagttaaatatttagggacatgtactaagttttacaaacagtacaaatatttaagagtgttgattgggaggcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 403950 - DNA, 1047 bp, Homo sapiens
gtgtatatcttccactttattggcagttgacattcccttactcacaagtaacagttaaatatttagggacatgtactaagttttacaaacagtacaaatatttaagagtgttgattgggaggcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaacaacaatgaaccacaacaaacgaagcaccgacaacaattgggcggggcgcccggccccgaaaggtattaaacccatctgtagggccggcccaggggacaccacatgcgcaacgggccaggaaccggtcggcgtgcgggttcccaaaaaagcgggaccgcggcgcaccccagggtgggccggttcacaggcaggtcgtacccgcgcggggcacagacggcagggagcgaggagcgagggaggcacgaggaggaccgacccacacccaggcacggcccacg

SEQ ID NO: 403951 - DNA, 514 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatgcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 403952 - DNA, 691 bp, Homo sapiens
gtgtatatcttccactttattggcagttgacattcccttactcacaagtaacagttaaatatttagggacatgtactaagttttacaaacagtacaaatatttaagagtgttgattgggaggcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgatgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 403953 - DNA, 1458 bp, Homo sapiens
gtgtatatcttccactttattggcagttgacattcccttactcacaagtaacagttaaatatttagggacatgtactaagttttacaaacagtacaaatatttaagagtgttgattgggaggcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatagccccagtgtcagaaaaggtagagaaagaaagaaaagcagttggtgggtccaagtaaagccttttccaggagatgaataaaacgtattccccagactggaagccatactctacccattctgattcctgggctcccacctcctctcccccttcccaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttttctctgtggtgtgtttcagagagctactagctccagtgtcgggggtgggagtggaaggttcaaaggtggtttccctgagggacaggtaccttttggggagagggtggaactagcttcctcttactatcccaactctcttctcctccatggcccttgtgcaggtgtctgttaggcaagcagagggtgggagttcccatccctcctgagagaaggtcctagtagccctgccccaagcttcctaattcaggacttgtttcctacagaagagaaacaaggcaaggtacaggcctggtccccagctctggctttctgcctctccacgtgctcatggcctctcccaggctaactctaagcagtgtcatgagtctgagccaggtgggagattaattcctgggggcacttcagggctgagaagggg

SEQ ID NO: 403954 - DNA, 1194 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatagccccagtgtcagaaaaggtagagaaagaaagaaaagcagttggtgggtccaagtaaagccttttccaggagatgaataaaacgtattccccagactggaagccatactctacccattctgattcctgggctcccacctcctctcccccttcccaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttttctctgtggtgtgtttcagagagctactagctccagtgtcgggggtgggagtggaaggttcaaaggtggtttccctgagggacaggtaccttttggggagagggtggaactagcttcctcttactatcccaactctcttctcctccatggcccttgtgcaggtgtctgttaggcaagcagagggtgggagttcccatccctcctgagagaaggtcctagtagccctgccccaagcttcctaattcaggacttgtttcctacagaagagaaacaaggcaaggtacaggcctggtccccagctctggctttctgcctctccacgtgctcatggcctctcccaggctaactctaagcagtgtcatgagtctgagccaggtgggagattaattcctgggggcacttcagggctgagaagggg

SEQ ID NO: 403955 - DNA, 329 bp, Homo sapiens
tgagaaacggaggcttgtgttttattcaaggcttgtcagcctccctccttccccctgcgggtgaggtaggaggcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaaaaaaaatcctctaaaaaaaaaaacgtttttaccaattcacttggcccgccaatttttacaaccgttggggaactgggaa

SEQ ID NO: 403956 - DNA, 222 bp, Homo sapiens
cggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcagggagccaaatatcctgtcggccgttttctcttcggccgcggcctagcttcagcccggagcctggat

SEQ ID NO: 403957 - DNA, 656 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaaaaaaaatcctctaaaaaaaaaaacgtttttaccaattcacttggcccgccaatttttacaaccgttggggaactgggaa

SEQ ID NO: 403958 - DNA, 602 bp, Homo sapiens
  misc_feature (154)..(155): n is a, c, g, or t
  misc_feature (228)..(229): n is a, c, g, or t
  misc_feature (382)..(382): n is a, c, g, or t
  misc_feature (581)..(581): n is a, c, g, or t
ctaagacaaactcagaccatctcttttcggtctgaaaaaataatccgtttaattgaaaaacctggaggatactattccactcccccagatgaggaggctgaggagaccagacccctacatcacctcgtagccacttcctcgtgcccgaattcgnnaggttcttgtgccccagtgtggagcaaaacattgcctgtcccattctgatatacttcagaatttgagaagcannaagttaatgtggaacaaaaagttttcaccatctctcaagccccaaaggactggaagccacctctggaataatgtgttaaatatctgtatattatatatatgtaagagaaaaatctaatttttttggtttgatttccttcccattaagaatctntgtttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgccactgctgtctaaactctgctctcctaantagctgactcctgaaatgaat

SEQ ID NO: 403959 - DNA, 915 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttaaaaaaaaaaaaattggagagtagttctctctctcgctgcgcgtggccccggaggagcacccagtgctgctgaccgaggcccccttgaaccccagggcaacggaggagaagatgactcagattatgttggagaaccttcaaaacccggggccatgtacgtgggccatccaggccgtgtgtccctctacgccttggggcgcaccatggggattggtcatgggaccttttgggaaacggggtcacccacagggtgcccatctagagggttaggccctcaccaagcaatcctgggtctggacttgggttggcggggactgaccagattacctcattgaagatcta

SEQ ID NO: 403960 - DNA, 1267 bp, Homo sapiens
cacagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatagccccagtgtcagaaaaggtagagaaagaaagaaaagcagttggtgggtccaagtaaagccttttccaggagatgaataaaacgtattccccagactggaagccatactctacccattctgattcctgggctcccacctcctctcccccttcccaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgttttctctgtggtgtgtttcagagagctactagctccagtgtcgggggtgggagtggaaggttcaaaggtggtttccctgagggacaggtaccttttggggagagggtggaactagcttcctcttactatcccaactctcttctcctccatggcccttgtgcaggtgtctgttaggcaagcagagggtgggagttcccatccctcctgagagaaggtcctagtagccctgccccaagcttcctaattcaggacttgtttcctacagaagagaaacaaggcaaggtacaggcctggtccccagctctggctttctgcctctccacgtgctcatggcctctcccaggctaactctaagcagtgtcatgagtctgagccaggtgggagattaattcctgggggcacttcagggctgagaagggg

SEQ ID NO: 403961 - DNA, 528 bp, Homo sapiens
gtgtatatcttccactttattggcagttgacattcccttactcacaagtaacagttaaatatttagggacatgtactaagttttacaaacagtacaaatatttaagagtgttgattgggaggcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtggggtatggacctcttatcaacatcagtttcctccttccccaccccgcccaagtttaggcactggccagtctggccctcaaatagctgttgaaggggtgggatgt

SEQ ID NO: 403962 - DNA, 270 bp, Homo sapiens
ggagacctgcaagcctgatggggttggggggtagtgttctctgatttctttaggctcgttttatagaaacaaagaacaagttctctcccctccttcccaagacttgtgcatatttacagagcacaactgcagttttaataaaacatctgttcttgcttctgctgatgagtttccataattgttttcagacaaatttaacaggaaaatataaatatatttagaaaaatctaagtcccagctttccccctatagacagccattcttttgcca

SEQ ID NO: 403963 - DNA, 335 bp, Homo sapiens
ctgggcctaggttggctggcagagcccctccaggaatatctgacaggagagttcatgtgctaattaagcatgcatctgatattgcagacacgacaatcaattagcatagctgattagacacctccacgaatgagctgtggtggctcctgaatgccctgaacccactctggcccactctcactcagagcaaccgcccccgactcactcattcatttgaagaaagagcagaggctttggtagagctgtggtctttagcctcagtttcttcacctacaacatggaaatattagcattaaccttgttgggttgttgtgagattaatatatggagagtac

SEQ ID NO: 403964 - DNA, 435 bp, Homo sapiens
tgtcaccctgagaataggttggttgatgctggatgaatattttagcttatgatgtttaagatattctaatattttattaaaagctttcttttctctctgtaactaagagttaacagattaaagcattattggaattgttcaagtcttgtgaaagtatgactaatttctggcattgacagctgttaacggtagaatttgagaaaacttttaacatacaatcttgcattaccagctcaatgtcatatattaaattttatgtcatatattaaattttagagtccatataaaagcataatgcagaaataaagctaaaaaccccaaatttgttaggatattaagttttaatacatagaaaaatgaaatttctgccaacctgtagttctagttcaaggattggtaattagaagttaacttggttttttaatagaacacaac

SEQ ID NO: 403965 - DNA, 618 bp, Homo sapiens
ttttcagaagatggggtcctgctacactgcccaggctgaacacaaaaaatgtatttcatttactatctaaagcaaatgggaatcattattatactaaattccctaaaacatagggtgcatcacaatccaaaggagactgtgaaaatttctgggaaaagtttgctcttttatcagaatcaggctgtgctagggaagagaggtagaggtcgggagaggttgagaaatggcaaccttactggtgagaatagtagcttccaactgataaattttattctaaaaatgcaaaaccactgcttcatgagctcaaatctgttttttctagctaagagaccacaggtccaaagaactaaagggcaagcagggacctcattatttatcaattccatcataattatttactgttgacttgaggctcaagttagaattcttatgtgtagattactatatttaaatggccatatccgttaaagaaggatgtattttgtagtatattgggtaattcttcaattaaagtaagtcgcattagtatcttaattattttaagaatgactaagtgaaataagtatactttaaattttattaaaacactcagtccttaattagggcttagttaagtcg

SEQ ID NO: 403966 - DNA, 402 bp, Homo sapiens
catcacactcccctccccctttttgtcaagttttaccatcctggtttggaaacagattcttgtgatcaaatttcagatcctgctaattaagacttttatcaacttaaagtataataaaaaaaatacaaaaaaaaaatcattcctctcctgtctgcagtactccccacaatccttccctagaatctccctgagcagagtatatcaggtaccaggtcaaagggaagaccaaatgagccattagtaatcacaacttgaagcccaaagccaagagcaacaggaggatgtcccagcagtcagaaaacgtagcaaggcctgaggacaaaggaattgtctctatacagtataataacatgatttgaccaacaaaacaatgacatagtgttttcccccattatggacaaa

SEQ ID NO: 403967 - DNA, 593 bp, Homo sapiens
aggttttggagtggctgtagccagcatcacacacggatggacacattttaccttctagaatacagattgtccttggagaaaagcaaccacacaagaatcaccctcagtgactactgggccccactcaaaaggagggcagcttacactcacagcaagatcctgttgcaacccggagaatcccaggatttctaaagtaaaggacctaagaaagcatctggttgttgacataggattaaccaaagaacatagtctatacttttgggtctttgatttgtactaggcagagtctttgtacctgttcttttaagcaggtaattcacaagtaggcagaacctaaattgtcaagtgggaattttgaaaaaactttactcaagtgcctcggcttcagactaagaattaatttcatcatggagagcagtttagctgcacctttctctggggtttatctcacttaattcaccaaactttacttgttccaaaaaccgtaaagtctttgtttgaaaggcatttcatcaagatgtatgatatgctctttttattcctagtggcagcaatacaaataaattaaacgtttataacttgaaaggtgtgac

SEQ ID NO: 403968 - DNA, 170 bp, Homo sapiens
aattgagtaccagggggacccggagctgcagcccatctggagctatgagatcgccagcttggtccacacgctcttcaggctgtcgtctgccatcaaccacagagtgggcaggagggcaggcctggcctcttcagagagggttctagatgctcctgcttggggtgcagtcc

SEQ ID NO: 403969 - DNA, 479 bp, Homo sapiens
ctgctctcccgagaggcgggcagggctggggctaggggctgtccaggagtgttctggactgtcccgtcgccaccattcccacaggctgctcaggaccgaggctgagacgggcgaccaggacgggactgtatggctgcaggaggctacacagcctcaggaggctgcttctaagaggcccacgtcgcctgcatggggacgcgcctggctctccagcatgtggtcatttgaattgtacatgtttcactaggatgcctacagaaaagtatacagaagatctggaaaaagtttttgaaatgttgaaaacttagctacttttaaaatgaaaaaaatagctttataattatcaaagcaatatatcccagtgtaaattttaaaataatttgctacattatagtaagcatcttatctctatgtgccctataacattatgttgtatagtttaaatatatacaataaaatttattttaaaaaatagcagg

SEQ ID NO: 403970 - DNA, 353 bp, Homo sapiens
ggtgtaaagaatatagactttggagttggctgggcctggatcaggatcttggttctaacacttgccaactgtattactgacttctttaaaagtcttctgataaatgaggataaaaatccctaacccttgcctttataagaactgataaaaataaggttgttactattattttgtactacacagcacctgacccattgccaggccccatatggacactattgaatcattaatagagagtggtctatggcatttccaaaagagcatagggcctaacaaaaataggatatgaaatgtgttcatgtgaaagaggaaaagagaggtaagtctaaacatttagaaatgcctgagacaaa

SEQ ID NO: 403971 - DNA, 493 bp, Homo sapiens
gttgcacacgtctttaaagtccaccagaatccaacgaaatggagcctcgaggaaaagaagagatttagccgcgaaggattctgggaatgctgggcttacaggggcgccgatcttcgctggcgctaggcgcttggtttcctctccgcagctctctgcgcacggtacgcctgtccctcgttggccttccactcagggcaatcaccagccactctcagggtcctcttgagccgtactaaaagtttgggaagactaaaggaaatcagaagtccctcagtctgaacaggacagccgtgagtgggtggcctgggaccctcaaagtataaaaacctatcggccggcgggaactgcttcagtcatttcaggggcagtgtttgatcagcacttctgcgggaggagattcctgaatcctgtgttccttaagggcttccctgctgcaggctggggatgtttcaatggactttccctcgagccctttggaaattacttcttaagc

SEQ ID NO: 403972 - DNA, 454 bp, Homo sapiens
attctctccaggaaaagtgaggaaggcttcataatagccatatggaacttgtcgtgagaatgggggttttcaatgaaagaaaagtcattttaagcaaagaataccttgctgtggtttgaatgtgtcttccaataagttcctgtgttggaagcttaatctccaatgcaacagtggtatgaaatgggctctaataagagttgattggacctttcctaataagagatgattggataaatggattaatgttgttgtcatgtgagcaggttagttattgtgagagtgtgtcattgtaaagagaatctgatcactggagcctctctctgtcttgtgtaccaacttctcttccaccatgctatggtatagcataaaggccctcaccagatgctggagccatgctcttggacttcccatcctccagaattgtgagaaataaatttattttctttacagatta

SEQ ID NO: 403973 - DNA, 226 bp, Homo sapiens
gagcagaggagcagaagagcgcaccgacagacaccagcagacaacagcaggccattgaggcaagacgatgcagaaaattcggtcggggcagtcagaggagagtccagccgctggacagcctgactccaggggaagaccgccttcccactccatcccccttctggctccccatccaccttgctgagagcaacctccaccacacaataaaaccttgcaccgatcttcc

SEQ ID NO: 403974 - DNA, 379 bp, Homo sapiens
cagtccacctgcctcggcctcccaaagtgccgggattatagacttgagccaccacatccagcctcaactttaaaaataaaaagaacacatgaagattgggagactatgcattttcatgtatagcctaaatttagctagtttagtgataagtatgctctgaaattaaactgattactgtatgatatcatggcctgtaaagaacttaaagaatacttaaattatctatttttaaatgaaaacttcaaaagccagaatttattttttaagttgtgtatcatcatcttgtctgctttaattatttttaaagtgtcaacataaaaacttggacatacaaaatgcatgtatttagaaataaaatgatgaatgtaacatttaaaat

SEQ ID NO: 403975 - DNA, 914 bp, Homo sapiens
cttgaaatgtagttaatatgctaagaaagcccatttaaatttttattttcaacttacttaaattcaaagagccacaggggtctagtggctcctgtattgacagcacagggccaccttgttagtggcatcatttataaccctgggcagcattgctataggaatagccatatcctgtaggtctataatgctgtagaaatggaatgtgtggtgcgaatgaaatttaaaatttaagtagccacggtgaaaaaaaaagagaaacaagtaaaattcatttcataatatgctttatctctatttccaaaatattatcatctcaacatgtaagaaatataagaagtattcatgagatattttacattcctttgttcatcataagtgtttgagatcccatgtgtgtctgacacagcacctgactttgaactcaccacatttcgagtgccccatagcccatgtggccatggtttagagatttcagaaagcattcatggaaaattctctttcctgatcctcattcactatcctgggaagtggccagataaggaagcaaggcccagaagggcccagccagtggctctcagactccagagtcatcgagtccctcactcgagggcaggttaactcacagatggctggcccccaccctctgcatttgccatccagcaggtctgggtgggtaccaggatgcggattcgtaacaggagaggctgatgctgccagtctgggtccacattttgagaagcattcctccaagggtcccacccacgctcataccccagtaagtagatggctcagaattgaaatccttgctttccatcttacatctcattctctttatatgcacaaccatgaagccaggttgctaagacagtctgaaaacaactaccaaagaacagaggtgctgctcatggttaccc

SEQ ID NO: 403976 - DNA, 1044 bp, Homo sapiens
cttgaaatgtagttaatatgctaagaaagcccatttaaatttttattttcaacttacttaaattcaaagagccacaggggtctagtggctcctgtattgacagcacagggccaccttgttagtggcatcatttataaccctgggcagcattgctataggaatagccatatcctgtaggtctataatgctgtagaaatggaatgtgtggtgcgaatgaaatttaaaatttaagtagccacggtgaaaaaaaaagagaaacaagtaaaattcatttcataatatgctttatctctatttccaaaatattatcatctcaacatgtaagaaatataagaagtattcatgagatattttacattcctttgttcatcataagtgtttgagatcccatgtgtgtctgacacagcacctgactttgaactcaccacatttcgagtgccccatagcccatgtggccatggtttagagatttcagaaagcattcatggaaaattctctttcctgatcctcattcactatcctgggaagtggccagataaggaagcaaggcccagaagggcccagccagtggctctcagactccagagtcatcgagtccctcactcgagggcaggttaactcacagatggctggcccccaccctctgcatttgccatccagcaggtctgggtgggtaccaggatgcggattcgtaacaggagaggctgatgctgccagtctgggtccacattttgagaagcattcctccaagggtcccacccacgctcataccccatgtctgacaatgcctgccaggatgggcactgatgaatatggttgaacggaactccaaggaccacccaggttgatagtagtgagtttgtgtacagaagactgcaatgaattgaagtcatgagacatacagccaggatcctgaaagccaccaacatatgtcacctgcctgggaggcttgcttcgatggtcatcttgttctgcctgctaagaccaggagtcacagctgttgacatcatggtgaataaaaacattttctgccacaggtagaaa

SEQ ID NO: 403977 - DNA, 1166 bp, Homo sapiens
cttgaaatgtagttaatatgctaagaaagcccatttaaatttttattttcaacttacttaaattcaaagagccacaggggtctagtggctcctgtattgacagcacagggccaccttgttagtggcatcatttataaccctgggcagcattgctataggaatagccatatcctgtaggtctataatgctgtagaaatggaatgtgtggtgcgaatgaaatttaaaatttaagtagccacggtgaaaaaaaaagagaaacaagtaaaattcatttcataatatgctttatctctatttccaaaatattatcatctcaacatgtaagaaatataagaagtattcatgagatattttacattcctttgttcatcataagtgtttgagatcccatgtgtgtctgacacagcacctgactttgaactcaccacatttcgagtgccccatagcccatgtggccatggtttagagatttcagaaagcattcatggaaaattctctttcctgatcctcattcactatcctgggaagtggccagataaggaagcaaggcccagaagggcccagccagtggctctcagactccagagtcatcgagtccctcactcgagggcaggttaactcacagatggctggcccccaccctctgcatttgccatccagcaggtctgggtgggtaccaggatgcggattcgtaacaggagaggctgatgctgccagtctgggtccacattttgagaagcattcctccaagggtcccacccacgctcataccccatgtctgacaatgcctgccaggatgggcactgatgaatatggttgaacggaactccaaggaccacccaggttgatagtagtgagcaacgaggtgcactgagcacttgtcggggctgtgtttggagcccatcaacagtgctaccagctttagttccatcaaccccaggcttttgtaacaactggttgcatgaaaccctcccttgtagtttgtgtacagaagactgcaatgaattgaagtcatgagacatacagccaggatcctgaaagccaccaacatatgtcacctgcctgggaggcttgcttcgatggtcatcttgttctgcctgctaagaccaggagtcacagctgttgacatcatggtgaataaaaacattttctgccacaggtagaaa

SEQ ID NO: 403978 - DNA, 528 bp, Homo sapiens
cagtgatgcttctgagagcttgagctttggaatcagactgcccacattcaaaccccagttcttcctattgctggctgtgtgatttggggaaaattacttgattccctaagttttctcatctgtgaaatggggattcactcagttagtgaatattattcagctcctaccatgtgcagacactgttctagtgggggattcagcataccagcagtaaatggatctctgtacaatgccaaaaacatgaagccaactattcatagtatttttaagtgatatcctggtgctgcttccaggaagatggagtagatatacttttccctattgctcccactaagtacaactaaaaccctggacattatgtataaacatgcataagaagatgctgaaaggtggtaagaaagcagactggccagggactttgcgatccaaggaacaacctggtgatgagtttcctgtaccccagacttgggataaaggagctggcaacccagaaatgccaacgggagcaaataaaaaatccccaacaaa

SEQ ID NO: 403979 - DNA, 462 bp, Homo sapiens
ccttataaggcagcgctaccacccctagacctcgggatgagttcacacccattatacaggtggggagctgaggcgccggacgtcaagtggctggctccagcccgaagactacggagaaaacaaggctgaaatcttacagctaatcaacaccttgtagcttaacaccccgcttcctccaccccctacttcacgcagcaggaaacaggcttgcccaaactccgcgagtaaggcagagccggatccatctaggcttctctagttcctatgcattcattcatccgaaaatacagagcaacacctctgtgccaggcaccaagccaggtgctggagaacacagtgatggcagcaagatagccaggctccctgcttacttgctagaagtggagggagcaagtgagggcagggtgagataaaggtaattattctgtaaataaacaaatagatggtttcagagagtgacaa

SEQ ID NO: 403980 - DNA, 439 bp, Homo sapiens
cgatataatttattcataatgaaaagcagcagtcttctgccctgtcctacctcttcccacccttagattctactccacaggtatttgttttttctcaatttctgtttcttggttgtttcccccatatctactctggtattcttgaagggaaaaggataatatgccgggcgcggtgtctcacgcctgtaatcccagcactttgggaggccgaggcgggtggatcacctggggtcaggagtttgaaaccagcctggccagcatgacaaaaccctgtctctcctaaaaatacaaaaatgagccggacatggtggtgcacgcctgtaatcccagctacttgggaggctgaggcacgagaatcacttgaacctgggatgtggagattgcagtgagctgtcgtgccactgcactttagcctgggcaagagagcgagaatccattt

SEQ ID NO: 403981 - DNA, 600 bp, Homo sapiens
gactttccagtcaggatttaagagcttgggcaagggaatcaggcaagaagaaaattgttaaccaaaaataataatttcctccaaagttcattcattcaccattgtgtcatgtcgcttcttaataagagcattttgttcatttactatgtgctctgggaaaaacaaggaatcaagcatggtttcttccctgaaactgcttaaaatcaggtcaagatgttaccggatggtatagataactgtcaaatttgaaggaaatggactatgagaaataaagtagaaagatatacagaataattaattttgaaattagctagactttgtaaaagagattggtctctaaacttcaaaagactgataagatttgaaaagatgaaaaaaaggcttacatagtgagaataatataatttaaaaggcacagatgggacaactagatagcaaaacatggattgaaaatttttgaaaaagttcaaatagacatgttttattagaaacattacaggttttaaaagccaggcaaatgagttgttctcctttcttagaacaatggtttacattagaatttgtattaaagattccttttgttataaatgattcttaatt

SEQ ID NO: 403982 - DNA, 314 bp, Homo sapiens
gactgtaagtcataaattagttaataaaatctgtcctgtgttatctctaaaacagcctattttatatatatttgtctatttggtttatttgtttctctgcttacccaggctgtattttggtagcataaatcaatatatgagttttagactatgcaaaagtttatttataaatgacctgccttctgtgaataaaataatatgttgtgtatatgtgtgtgtgttgtatataatttattgctattgatcaatgttaaatttaaatttaaatacataatactaatgagtccaatgaaatgtgcatattgctatattcc

SEQ ID NO: 403983 - DNA, 388 bp, Homo sapiens
ggccacagtaaacagctcaactgcagccttcaaactcctggggctcaagtgaatccttcatgcttcagcctccccaagtagctgggactacaggaacgcgcccctactcccagctaatttttaaattgtctgtagagatagtgtctccctaagttgcccaggatggtcttgaactcctcactcaagcaatcctcccacctcagcctcccagagtgctgggattacgggcatgagccatcatgcccagcctcgctcatgttgcttctggctcgaaaaagatttcagtggttgctcattgtctatatcaaccactcttttttttttctcttttttgagatggagtttcgctcttgttgcccaggctggagtgagattccgtcttaatctt

SEQ ID NO: 403984 - DNA, 937 bp, Homo sapiens
agtcaaagcagcaccagctctgatcgaccccctgtatttgatggctcaggtcaggtattactcagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggtcaggctgggctagggtgtgaaggggcagggagggccagcccagcagggaaggaggaggacggtacatgactgggga

SEQ ID NO: 403985 - DNA, 1065 bp, Homo sapiens
agtcaaagcagcaccagctctgatcgaccccctgtatttgatggctcaggtcaggtattactcagagctagagaatgcccagagcatcctgcagcgttgcctggagctggaccccgcctccgtggatgcccatctcctcatgtgtcagatctacttggctcagggcaactttggcatgtgcttccactgcttagagctgggtgtcagccacaacttccaggtccgagatcaccccctctaccacctcatcaaggccagggccctcaacaaggctggagactatccagaggccataaagacgctgaaaatggtcatcaaattgccagctctgaagaaggaagaaggcagaaagttcctcaggccctctgtgcagcctagccagcgggcatccatcttattggaactggtggaggccctccggctgaatggggagctacatgaggccaccaaggtcatgcaggacaccatcaatgagttcggtggcacaccagaagagaaccgcatcaccattgccaacgtggacttggtcctgagcaagggcaatgtggacgtggcgctgaacatgctaaggaacatcttgcccaagcagtcctgctatatggaagccagagagaagatggccaacatctacctgcagaccctcagagacaggcgcctctacatcagatgctaccgtgagctctgtgaacatctgcctggcccccacaccagcctgctactgggcgatgccttaatgagcattctggagcccgagaaggccctggaggtctatgatgaggcctatagacagaacccacatgacgcctccctggccagcagaattgggcacgcttatgtgaaggcccaccagtatactgaggcaattgagtattatgaggctgcccagaagattaatggacaggactttctgtgctgcgatctgggcaaactgctcctgaagttaaagaaggtcaataaagcagaaaaagttttgaagcaggcactggaacatgacattgtccaagacatcccatccatgatgaatgatgttaagtgcctgcttttgctggcaaaggtttacaagag

SEQ ID NO: 403986 - DNA, 325 bp, Homo sapiens
ctgttatccttttctcctaggtaaacgtcagaaaagatcaatcaccctcatcaattcattaatttagtcattcatccaactaccctcttgccagtactctgtatcaatacaatgtttttcagtagggtgacgggaaagaaaagaagggaagacacaaagatgaaaaagacaaattactattttcaaagagcctagagtctagaatgagcaccaccattggtagataatagttgtatctatcattgttatgcaatagttatagcttaaaattaacagagtcagtatttctttttcctttttacattagcatgacaaaaatatcaca

SEQ ID NO: 403987 - DNA, 449 bp, Homo sapiens
gtcaaaacctgtcaaaggccaagtgctttatttccctccagtcaaggactgggcattttgcatttgaatcctggatggcgggaagcagcaagcaggtgtcaacaggggtggggaggagacgccggaccccaccagccaatcagagcgcgcagaggcctcccttcccccgccgccgtcccgcgccaaaattccaaacgggctacgcaccgctcccaccgtctccttccgccgagctcagcgagccggaactatgtgaagaaaaagaagtcagcgttttccccaggactctccgctcaggtcctctatactgtcggcctgtgttcctctccacgttggcccggcctccttcgctctacaaatgggaggagagtttcgagcctgctgttctatggtggtggcgtgggcgggacagacggcggagggattctgggcgcgcgcgctgcggccgc

SEQ ID NO: 403988 - DNA, 671 bp, Homo sapiens
gagagacaactggacaggtgatgctttgtgctacaaatgggaaccgagagagggaaggtggtgatcttttgttgggcacctcctgaacactaatgctttagtcagttttctgttttgttggacacactgaattcttggttgattggttagatgtcttaactagtccactgaagtttactccatctatgtgaagatatgtgagatttcacacctacagtataggggataagccagaaatacatttaggaaaattgaggcccacagaaagttacagatgcgactagaattcaggtttcctggttccttaattttgattcctaactctctttgcctctacttgttgctgtttttgtttaaggtagaacaaagtgttaaggacacctttaacatgaggcaaaaagaatgactggagtaacagtattacacaatggcttgtactgtaaccccagttacttgggagactgaggctggaggattgcttgagcccaggagttcaaacccagcctgggcaatgtagagagaccccatctctaattacaaaaaaacaaaaaagtatatcgtggggtgggaaatgggaaataagtgatatgacagcagccatatgaggagcagaggggtaacaaacttggctggcatgatattttgcggtagtctgggacagctaagagtgt

SEQ ID NO: 403989 - DNA, 260 bp, Homo sapiens
tcctcctgcttcagcctcccaaagtgctgggattacagatgtgggccaccgcacccagcccttttctttagtaataatactaataaagtaggtcactaacgtgggaataacttgaaaaatgtgggaataacttgaagaatgtttaacctgagttcagagcatcccagatggaatatataattgttaaactcaggaaaggacaactgaacattaacctcattttctaaatttcttttcccaggaattaaagcatgaataat

SEQ ID NO: 403990 - DNA, 501 bp, Homo sapiens
ggctgcaccagtttacatttccactagcaaagcataagggttctaatttctcagcatctttaccaacccttattattatttgactttttcatcctgacttttgattctagtgagtatgcagtgatatcttgttgcggttttgatttgcatttgccaaatgattaacaatgtggatcatattttcatgtgctaattgaccatttgtatatcttctttggagaaagtctattcaagttctttgcccgtttttgaattgcgttgtttatctttttgttgttgagttgtagaatttttaatatgttctggattattatacccttatcagatatatgactagccatattttctcccattttgtggggtttcttttcactttcttattagtgtcctttgattcaaaaatacttttaatttaatgaagcctaatttctctatttttttcttttgttgcttgtgcttttggtgtcatagcttagaatccattgctgattcaaggtcatg

SEQ ID NO: 403991 - DNA, 820 bp, Homo sapiens
ctggaagaaactcaagtcatgtacccctgctcccctcctcctcttccacttcctcacggtcatcatcccctccatccccacagtctgagggagagagcatccacgccagctggcttgataaggtggaaagagcacagactttggagttagatgtgggtttgagtcctgactctgctactcaccagctttttgatccaggtaaatcttctcatcccctcatctggcagggactaagtagccttaactacaaattggaggttttgtcatccagaccccatcaaatagccaaaaggagatgatgaggcagtatggatgcagctcctcgtaccgggtcagtagagatggcatcaatgtcctcatcacagcgatggcgagtcacaggtgaggaaggtgaggccaacagatgccaagcaacttgcccgagatcccatagcaggcaagcagccaagatgagcttcagattcaggtctcttgactctggcttgaaggctatcttttgtcctccctctatttctactgaacttggtttcagcaggaagcagattgagcagcccagagccagagggcaagtgacaagctgacttggctttccttgaagagcatccataaccccaccttcctccagctctggcagaggacagagctcagcaaagccagtttcccagccattccccccagccttgctaggcatcagccaagcaaaacatcaccaggggatttaagaaacactgtgcattgggcattaagagattggccattgctgccttctagtgtccctgtaaaaaaggtcagtcactccaaggcttgaagttcatggacc

SEQ ID NO: 403992 - DNA, 490 bp, Homo sapiens
aaaaatagttgcaatgtgaatctaagaaaataaagatgtggagtacacagagctttgcttcagattctctggactaaagactgacactcatctagatgccaaagatcccatcagtcaccacattttttagacttctgactgctaagaaatattttggatcttcagaatagagacatctggcagtcaccagctgaacaaaatcttcaaactttgcaccaccatcatgggacagcctgacatatgtgcaccttgagataagattccacaggatgcgagcatatgcagtggaaacattgtgttattccatcctcagaagaaaagagacagtattatacttcgtctcttgctagtacagaacatgagatcttgtggacagagactcagagtttcctcagtgctgataagaaactggcaattaccagacaattaacaaacatttttgaataaatgaatgactgaataaatgactggtgttattaccgttgaccca

SEQ ID NO: 403993 - DNA, 136 bp, Homo sapiens
cacttggcaaagaagagaaagaggaagagggagggaaagaggatagaggcaaagaagagaaaaaaaggaatggaagaggaggggaaacattgtgatcctctcttgcctctgctctgtgccttgctataataagcat

SEQ ID NO: 403994 - DNA, 461 bp, Homo sapiens
gacagagtctccctctgtcacctaggctggagtacagtggcacaatctcggctcaccgcaacctctgcctccctggttcaagcaattctcctgcctcagcctaccaagtagctgggattacaactgtgaaccaccatgcccagctaatttttgtatttttagtggagacggggtttccccatgttgacgaggctggtctgaaactcctgacttcaagtgatccgcctgcctcggcctcccaaagtgctaggattacaggcataagccactgcacccagccaaaattaaaaaaaaaatcttaaacatgatataaatattcttttgtatgtattagttggtgcaaaagtaattgcagtttttgcctttactttcaaattaaacctatattaaatatgtaataaacctatattatatatgtaatacaattaaatttaaagagcaagtggaaatctgtactaaaa

SEQ ID NO: 403995 - DNA, 487 bp, Homo sapiens
ccatctaaaaccaagatttaatccaaggccatacactttccacaacatcaaactgcttgccctaaaatctgtccaaaattatttcaagctagacctttaactatcttcttaacaagttacccagaaaaatatgaatttgcctatcaccatatctacaatctttcccatttgttactccagatcagtggctcagtggatccctaatgtaacctacatttgcagccttcttccgtaagaattctctgccctgaattgttctattgactaaccacattacagaatcaaaaacagtatgatttcaaggagacatttaactcattcaataccaccactggtgggagtctgtactttctggtttttggtttttgtttttgcttttttgcctcattaaagaaatgaagatcataaaaatgaattatgtttttctggaaattcatagaaatgtgtttgctttctgtgtttaaatatacagtataatttatacata

SEQ ID NO: 403996 - DNA, 292 bp, Homo sapiens
tttttttaacaatagtgattgaataaccattgagttactgacagaatttcaaagggataccaatttgtggtcatttttacatgcttattatttctgtaattgcatactaacaaagtgtatctaattaacaggtagttacacttttgtgatgctgttttcataaagaagcaatgtagtatagtagaaggagcaatggaagagatgttggaaggccagagttagaactccatcactgtgatggttaacactgagtgtcaacttgattggattgaaggatgcaaagtatttatcc

SEQ ID NO: 403997 - DNA, 715 bp, Homo sapiens
ttgataaatgttctggggcaggagagcaatcctcaccccttcaccctattgaaaacccatgctttaaagaggctgtttcttacacttcttaacccttttccatagttcataggtttttaactttcctctatttcacttgactcttcaattctttattatcattatgattttacgaccatctttctacttcctgaacctgaaattctttcacatttagctgtaggaatagtatgacaaaacagactttcagggttcaatcttgtcttcaactggtgacaaatccagcataccttacaaatctgaacaagtcagaaggatataggaaaatgtattttgaaatacctgggcactggtttaataaaggaccttctactttatccactgccttgtcttcctaccccccagacacccgtaaagcttgataccattttggatgtctgtaaactggcatgtaacttttgctgatgctatttgtgtttcctttcagtgcaatagataacacagatagaagtgctttgtgaactatgaatcacgatatcatacagagtgacacatgccttctaggtccacgttgtataatagcaatgatgggctgacgctaccctattcttgggatccaaaaggatccaggtctctgataaaacaactttctaccaaaggcagaccaggctcacaatttcttcatctcactatttataccaatgcttgtttaaaa

SEQ ID NO: 403998 - DNA, 636 bp, Homo sapiens
tctcatcatgctgtgtaccacatctttcaaatattcacaagcttgaagatgtctgcttttgggtgtgtgcagataccctaccctctgccagaaacatgtgcctttacaactcacactagggactcagtatttgaaaagttgcttaatgaacattttataattcatatcctcatagtttattttttactgctagattttagggaattgtaatgaactggtcattaaaacctcttttcagcattttaatctattctatactaagtatttttctgttaataatgatactagagccaaaatcatattttccttcttaaaatagtatcatttttaagcttttaacagtaatacatacctgagatggtactgatggcatctaatcattatataatatgagttttgaagggacaattttggtagctaaataatcttgttcataatgtttttagcactaatttggaatcatggagcttttattatggagctggcataaatttatctgtaaatcgtgtaaatgtttagatggtccatacatatataaaaatagctttgttatgctttaaatattgctccttcggctcatagagtatattcagagatatctaccagtgggtttttgtgctgctgtagcatcttcca

SEQ ID NO: 403999 - DNA, 681 bp, Homo sapiens
aaggaactgggaaaaatatcagtaaaattattaaatatctagaatttagaaaattgtgagagaacatagtgttggatgtaagagaaagtttaaatgatctaatgctacaacaatttgagagaaatatatttgcacatatatatcagcataattatatcgaatttgtgagacttttcattgttattaattggacagtttcttcaagttgactgtaaaacacttccaggaaaagtagttctctaaaagtaaaaataactctaagctaggagaagatctgagataacaattcctactcttccactcaactttcacaagttgtgcagtatctattgatgtgttttgaatttttcaaaatttttgtaatgatactctatatacaaatttgtgaaagactaattggtaccatattaaatatactttgtaaaatattacataattttaggtagacattgtgttttcaaaaaatataacattttaaatttcttttattctaattttctctccctagcttatctagccaatttaaatgcaattcttaccaaatgataatgacctaatattgcatctttagcattttctttatcacaaatttataaccaagaaaacaatcaactacgttgtaaaaatatgacggatatctacataaggaaataatcctaaagtaatctgctaaacacttga

SEQ ID NO: 404000 - DNA, 1942 bp, Homo sapiens
cggtccagcccggcagcgggtgagagtgggtgctggccaggacggttccttcagagcaaacagcagggagatgccggcccgctccttcccagctcctccccgtgcccgctaacacagcacggccgcctgcagtctcctctctgggtgattgcgcgggcctaagatgtgtcctggggcactgtgggtggccctgcccctgctgtccctgctggctggctccctacaggggaagccactgcagagctggggacgagggtctgctgggggaaacgcccacagcccactgggggtgcctggaggtgggctgcctgagcacaccttcaacctgaagatgtttctggagaacgtgaaggtggatttcctgcgcagccttaacctgagtggggtcccttcgcaggacaaaaccagggtggagccgccgcagtacatgattgacctgtacaacaggtacacgtccgataagtcgactacgccagcgtccaacattgtgcggagcttcagcatggaagatgccatctccataactgccacagaggacttccccttccagaagcacatcttgctcttcaacatctccattcctaggcatgagcagatcaccagagctgagctccgactctatgtctcctgtcaaaatcacgtggacccctctcatgacctgaaaggaagcgtggtcatttatgatgttctggatggaacagatgcctgggatagtgctacagagaccaagaccttcctggtgtcccaggacattcaggatgagggctgggagaccttggaagtgtccagcgccgtgaagcgctgggtccggtccgactccaccaagagcaaaaataagctggaagtgactgtggagagccacaggaagggctgcgacacgctggacatcagtgtccccccaggttccagaaacctgcccttctttgttgtcttctccaatgaccacagcagtgggaccaaggagaccaggctggagctgagggagatgatcagccatgaacaagagagcgtgctcaagaagctgtccaaggacggctccacagaggcaggtgagagcagtcacgaggaggacacggatggccacgtggctgcggggtcgactttagccaggcggaaaaggagcgccggggctggcagccactgtcaaaagacctccctgcgggtaaacttcgaggacatcggctgggacagctggatcattgcacccaaggagtatgaagcctacgagtgtaagggcggctgcttcttccccttggctgacgatgtgacgccgacgaaacacgctatcgtgcagaccctggtgcatctcaagttccccacaaaggtgggcaaggcctgctgtgtgcccaccaaactgagccccatctccgtcctctacaaggatgacatgggggtgcccaccctcaagtaccattacgagggcatgagcgtggcagagtgtgggtgcaggtagtatctgcctgcggggctggggaggcaggccaaaggggctccacatgagaggtcctgcatgcccctgggcacaacaaggactgattcaatctgcatgccagcctggaggaggaaagggagcctgctctccctccccacaccccacccaaagcatacaccgctgagctcaactgccagggaaggctaaggaaatggggatttgagcacaacaggaaagcctgggagggttgttgggatgcaaggaggtgatgaaaaggagacagggggaaaaataatccatagtcagcagaaaacaacagcagtgagccagaggagcacaggcgggcaggtcactgcagagactgatggaagttagagaggtggaggaggccagctcgctccaaaacccttggggagtagagggaaggagcaggccgcgtgtcacacccatcattgtatgttatttcccacaacccagttggaggggcatggcttccaatttagagacccg

SEQ ID NO: 404001 - DNA, 383 bp, Homo sapiens
atgtactgctccctgtatattgcaacaatgtgaaatagaagtatggcagactttgagggaacaagattctaaattcccagaatatcactaatttattttcatataccagtgcagaatttttttctgaagacaggtgtaaatcattttaacatgatctttataaccaccacctttctattaatcaggcaatcatcaagaaagaatttgattgtgaagggtccagattgaactgttctttaagtaaggacacaggaaatattaagataactgtatggaaaaatctcatccaagaaactggaagctatgggaaaaagaaaattaaagattctttgattttagtaggttggttgagttatacatatttttagcagagcaaaaaaaga

SEQ ID NO: 404002 - DNA, 289 bp, Homo sapiens
cagatgccgcggcgcacatgatacccgttttaggtcttgcaccacaggtccttgtttattcttacaggtaaccttagaaccattttatccagttctagccaaaattattttggagctttaattgtaatggcctgataaacatgcttacttgaaggaaaatgaaatgtctacagcgttggccgtttgtccagaggcaaagatgcctctctttcaggcctctcccacatcctttggttcaagttcaagttcatgggttttaccctatggaatcagcaaaaggagcccagag

SEQ ID NO: 404003 - DNA, 640 bp, Homo sapiens
gattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtggg

SEQ ID NO: 404004 - DNA, 514 bp, Homo sapiens
gcaatcctggcgtctcccaatgagagggctctcaaaatgaagcttttaataaactccagagtaaggaactcgggattgtgcggcaaaggccgcgcattgcactttgtgagcaatcggtaaatatgcgcaaccatatgataggaaatatatgcattttcattgataagaaaaaaagagatgatggtatttttaaacagaagccacaaacaggcatacctgtgccattgttggggagctaataataaaggcactgatgatcacaggagtaagaacaattgacttggccaagagacaattttaagctgggaactgtattcggctgcagttcagaaagtggacttttgagacttgtcaaacgaatggaagaattttgtgccaacaatgtcccagctttgcaggcttggcagctgaggactcagaagtaacaaattaatgccaggtgaattattattgttactactattatcaaaatgtgttccagttgcagcaatacaatggataagcaacttcaaaa

SEQ ID NO: 404005 - DNA, 466 bp, Homo sapiens
gtgaattcacccttcctcagccttttgttctattcaagccctccatggattaagtgatgcttgctcactttgaggagggcaggtctgtactcagtctactgactcaaatgttaatctcttccagagacaccctcatagacacatgcagaaatgatgttttatcagctatctaggcaacccttaatgcagtcaagttgacacctaaaattaaacatcacaagcagggaagatggtgtgggaggtgaggtgtgtctgtgagcagaagctgggtgggtctctgcatgaacatgtaggtacgggtgcaagcatgtgggagctgttggtggcaaaactcaacagaatcaactcatatttaggaagtgaatcagatgtcccatcctctgagccctgtgacatttcatgatctggagcaataaaaaactctcagagcaagatgtataataaaaagctaaattttcaagtatgg

SEQ ID NO: 404006 - DNA, 323 bp, Homo sapiens
tggttggattaataatgtgaccatttattattgccttgggtatcactggaattttcctacatagctttgttcacatgaaaaattaaagtttactgcatagtgcttgcttaataatttgttcagcaagcaatatgcaataaactttaacttttcatgtgagtatagactgtctccctctcttcgagttcactttgagtagtagacttttgtaatctcaatggtgcctcatccatagtagttgtttataaggcatttgttggaaagcgactgattatacttgggagtatttgtagtcacctgaaaatagtgagaagccacagctg

SEQ ID NO: 404007 - DNA, 530 bp, Homo sapiens
ccactcacgattacctcaagttaaaaaagccaactatagccaagtgcagtggctcacacctgtaatcccagcactttgtaactttcattaaacagatcccattttgttatgtatatacctaagtattttattttctttggagtgactctaaaatatattgtgtttttagttttggttttcaaatgttcattgatagtatacggagatggagttgactgttgtgtgttgatcttgtatcctgcagctctgctgacctgatttatcaattctaacaattgatttattttggtttttggtagattctctaagatattctatgtaaacgattatatcatttgcaaatagcaatggtttttcttcctttacaatatgcaggccttttatttctttttcttgactgataacagtgtcttgaacttccagtgttataagaacgaatctccttgccttgtttctggtcttggggggaagtattcaatctttcactattaaatatgatattcactctacgtgtttgggaggtgcccttt

SEQ ID NO: 404008 - DNA, 428 bp, Homo sapiens
gaggacataaaaatacggcgcggacgcggagcgaatactcttagggttgctcgaattgtcctctcaaaaagagtttgatcgactaacgcggaggcggcatggattggaacaggcacctccgcctgataatgttgataattaaagaggaccactggagcaagtcacaccacctggtacctcctaacctcccccttgccttttctgcatttcagatcctttcttaaaaaacccctgcgttccccccatgaattgaagagtggaattgtttgctgctcttcccctgctagcatggcagctagcagattttcctttattatccattctttctacaagcagagagcagccagatccttttgcaggttacaggctgacacatccagtttcttcgaaaaaaacatttaataaggacttataaacagaagctacgt

SEQ ID NO: 404009 - DNA, 289 bp, Homo sapiens
gatatgctgtctagatatgagaccaaggagttaactcttaagaatggcacttttgaaaaggaatcattaaaatggaaaataatagaaagtgtcagaagttcttgccttgaggaatcttttttgggaaatgattggaaatgcaaaggactctttgagagacaacaggaaactacagaggaatatttcaggcatgtaactgtgccatttgaaaaaatatccgaattcatccagcctacatattttcttctaaatcaaataattcatactggaaagaaactctatgaacaaa

SEQ ID NO: 404010 - DNA, 219 bp, Homo sapiens
ggcatgccccaccatgcccggctaatttttgtatttttagtagagacagggtttcaccatgttggtcaggctggtctcaaactcctgccctcaaatgatcgcccgcctcggcctcccaaaatgctgggattacaggcgtgagccacacttaacttcacatttcataattcctgagtcttatcaggcaaaaacaagtcctgaaaaaacaaagtaaatcta

SEQ ID NO: 404011 - DNA, 466 bp, Homo sapiens
ttagcccagtccaattctacttgtatggccacagatctccttattttgaaataaacaaaaagcaggaaggatccaccttctccaatttcctcaatcgcttctcccagggatgtttaagcttccatcatctaaactatacttggggccgggagttttggccactaccccctacagcctgtgcccttacaaacgtgatggcttcaaggctgggagggtgaatccggcttccactgcctgtgcttgaaaagagtaacttttgtgaacagtgccagagacaaactagaatctgatcctgagaacaactgctttcccttgagtaaagaacacatgtcagggaagagaagcacagactcttaaagaggggccatccaaagaaactgagaaaacaagaaggacatgagttgggcacctgaagatagaaacgggacaaaatgaaggatgaagagtaggggggaggtgaaggagc

SEQ ID NO: 404012 - DNA, 393 bp, Homo sapiens
taatggtatattgcaaataaatgtactatattatgtttttatattacaagttgaacatccctaacctaaaaatcccaaatctgaaatgcttcaaaatctgaaaatttttgagtgctgatatgatgccacaaatgaaaaattccacatctgacctcatgtgacaaatcacagccaaaatgtgatcaaaacattgtttaaggaagaacattatttaaaatgttttataaaattacccttcaggctctgtttataaggtgtatataaaacataaatggattttgtgtttagatttgggtcccattcccaaggtgtatgattatatatatgcaaatattccaaaatcagaaaaaatcagaaatctgaaacgctcctggtcccaagtattctggataa

SEQ ID NO: 404013 - DNA, 449 bp, Homo sapiens
gtactggcctggtaccatggttcccaaactgtggtgtgcatcagaatcacaggttgctgggctgcacccccagagtttctgactcagtaggtctcggatgggactgagaattggcatttggaacagcttcccaggcaatgaataccacgcagagaaccagggctggaggataatcctggtttgctcaggacagctcatgtggagcgtcaccctgtcccaggtgtgccactttacaagcccccctgggtctgactgggagtggggccagaccctgatgggtggggaggcccctgcaggagtgcaggaggcacagttgttgtcagggaagagagagggtgaggtcactgagctgaaacatggcatcaggggcaagagaggcagccttggcaacagtgacccagagcccaggagtaagatgtgtggttggaacccctaggaggccgttagct

SEQ ID NO: 404014 - DNA, 333 bp, Homo sapiens
cttctagggaaaagaagtaggtttgggctgggtaagaataagggatggggtcttccccctctgattttatatattctgtactgttagtaatatagttcctaatgattatgtacttttataactttataacaatagaaaagaaaaattattttacctcatcagattcccaatgctaaccactattaatacttttgtatgtatcgttataggcttcttaattaggatttactctgagagaagatatatgagcattttaaaattctaacgtgcctgttgcaaggcattagattttctttattaacaggaaaaaggtttaaattacagaaaaaaaat

SEQ ID NO: 404015 - DNA, 113 bp, Homo sapiens
cagaagtggggtgcccagtctttgcccctccagtgacagcaggctggccttcttcagggtagactgactacttggtttgctacagacttttatgcctcaacagaattcaataa

SEQ ID NO: 404016 - DNA, 514 bp, Homo sapiens
gtcccaataaatccatcagaccataatattcacactaattctgcttttctgactgaaacatgattgatacaataccctttgataattttttaattgagtggtttgtcttttaaccattttccctaagggttcttgcattggaattttttttctttttttgctatttatgtgctaaaattttcactcacaaactcatttctgatatactttcatataattgttaatcagtctttctagggttgcagtaatgtgcatgatattcttcttattgtcaagtaacttcaaccaaaccctccttgtctgctgattgttaccgtgttttctatttccacttaacacttgcattttaaaatccagtgtgttggccaggcccggtggctcacacctgtaatcccagcaccttgggaggccaaggcaggcggatcacaaagtcagaagatcgagaccatcctggccaacatggtgaaacctcgtctctactaaaaatacaaaaattaagccgggtgtggttgcg

SEQ ID NO: 404017 - DNA, 662 bp, Homo sapiens
agaaagttgtcagacagcatcacatgctacagagaaatctttcttgaaaggaagagtcaatggagcaaacttcattattatcctcttttttaccacagccactcaaccttcagcagccaccactctgttcagtcaccagccatcaatatccaggcaaaaccctcaaccagcaaaaagattaccacttgctgaaggttcacataattgttagcaatttttagtaataaggtattttaaaatttatgtgcattttttagacataatgctgttgtacagtagacttcagtgtaatgtgaacaacttttatatgcactgggaaataaatttgtggtttgctttattgcgacatttgttttgttgaggtggtctggaactgaacctgccatacctccaaggtaggtctgtacagtgccttcattgaaggcactaaataaatggttattgttgctatactcaagtgaaactgtctcaaaacaaaaaatgatagataaaaatgttgtaaaagaatttaataaaacttgatattctcataaatgaggttatctactaccactgaaaaactgtttgaactggtaaggtggctagaaacaacaaacatttgtaaaacagctttcctggatatgacaatagccagttagaaaagtaatggaaaaatatgagct

SEQ ID NO: 404018 - DNA, 408 bp, Homo sapiens
gcatacttttttataaataaatactatgaatattgccacattgttgggcctggttgcatggcagcctagtttcttttgaggaataatatattgtaacttccacaaaatatacgaaaattttattatttcaatgatatttgaactttttcaacttaagaattgtgcttgagttgtgagcttaaaggaggcatttgtgtgagctaagattcaaacagaaaatataagttaaatcttccttaaaataattaacaagaatgaaaaaatacttttcctgacatcgttttgtgcatcacccctataataccttcctaagagaacatagagaattgaaagaggtaaccatatgataacttttttccaaaatgcgtgttttctggaatcatatgtatgatttcaatatccctgcat

SEQ ID NO: 404019 - DNA, 1164 bp, Homo sapiens
ggggaggcctcaggaaacttacaatcacagcggaaggcaaaagggaagaaggcaccttcttcacaaggtggcaggagagacagtgaggaagtgccatactttaaaaccatcagctctcatgagacttcactcatgatcacgagaacagcatggggaaccttctcccatgattcaatcacctcccaccagctccctcctcgacatgtggggattacaatttgagatgagatttgggtgggtacacagagacaaaccatatctatcaattctgaatgtttaataccagtattattagaggaggatctagtccccttcaggacataaggatctatgatcctctgtcagaacatattagaccctttcctttggctataaccaaaagattataaacatacatccaggaataaaaatagtatattaaaattgtgtgtgtgtgtgtgtgtacgaatgtaaattttttgtgccaaatctaaagactctttacctagtcctaatgtgtcttgaagatcttctgcagttttttttctagaaattttatagttttatgttttacatttaagtctgtgattcatttttagttaattttttttgtataagatgtgaagcttaggttaaggttcatgtttttgcctatggttgttcaattgctctaatagcatttattgaaaaggttaatgatttatttgtacttctgccaaaattaattgatcatactcatgtggtcatacttccgctttctctgttttataccacttagctttgtctatcttgctatcaataccacactgtcttgattactgtagctatatattactgtagctatatagtaaactttaataaaaggaagattaactttcttcttcttttttcaaaatcgttttggctgtttaaggtctttttcttttggtatacattttagagtaaaagtacatacttctgtgaaataccttactaagcttctgataggaaatacgataaccctgtagaacagtttagggaggactggtatctttactaaatcttctaacccataaacatgatatttaggtcttcttgtctttcaccaacattttgtaattttcaacatgtagattctatacaattttgttgagattatgtcatctgtgaataaagactgttttatttcttttccaatttgtatgc

SEQ ID NO: 404020 - DNA, 291 bp, Homo sapiens
catgatttcttctccgataggcaacatattccttttgtaacaatctacagagatgaagagcataatattaaggtgaggttttcttatctgcctgtttaatattcaaatgagattggtaaacaccaactagctatttaacctgatcagtccaataatggcatacataattaatgctgggttcccatcagactgctggaagagaaataatggtcagaagcattcccaaataacaggaaatactttgagcttcacacataacactttaaaatgcatgttgcctttcggagaaga

SEQ ID NO: 404021 - DNA, 442 bp, Homo sapiens
caatgcttttattaaggtgtatttcttctgcagtgtgcagctctagtaagttaccctgttgattgtgtagcacttcctagcatgcagccacatttgacatagtatctattactatagcgaatggttggccctaattctatttcagaatctttgggctggtcacggtggctcaagcctgtaatcctagcactttgggaggctgaggtgggtggatcatttgaggccaggaattaatgaccagcctggccaacatggcgaaaacccatctctactaaaaatacaaaaaagtagccaggcgtggtggtgcatgcctgtagttccagctgctcgggaggctgaggcaggaggattgcttgaacccaggaggcagaggttggagtgagccaagattgcaccactgcactacactccagcctgggtgtcagagtgagactctgtctca

SEQ ID NO: 404022 - DNA, 369 bp, Homo sapiens
ttatatcctcctacaagtcattcctcatccctgtttggtaggctttctccttttgatttctgtgtcataagagacgtaacataagaagggccctggccaggcacagtggctcacgcctataatcccagcactttgggaagctgaggcgggcggatcatctgaggtcaggagttcacgaccagcctggccaacatggtgaaactccgtctctatgaaaaatacaaaaaattagctgggcgtggtggcaggcgcctgtaatcccagctactcgggaggctgaggcaggagaatcgcttgaacccgggaggcggagtttgcggtgagccaagatcgcgccattgcactccagcctgggcaacaagagtgaaa

SEQ ID NO: 404023 - DNA, 390 bp, Homo sapiens
atccctctctcctgcccctccctacccctctttgtatctttatatttactgtcctatcatagcttaataatcatttatattgaataccttttgtttaacttactgaatagtttctcctgtttgaatctctactggtacacaattggtgtctggagtggctccagcagatagatctgaaattctgagattttggcatttgggtggttatgcctttgggcctgagcgcagtgctgagctccttgtcagagggaaatggaatgctggtaatccatggcatcacaattaattaagctatcacctgtggttgattataatgtgttgctaatgaatgcagatgcctcagagcccaagtggctgctacatttgacctttatggcaataataactgta

SEQ ID NO: 404024 - DNA, 564 bp, Homo sapiens
ccctgttatagcttaacagtaactgaagagactgctttggaaaggcagcaagagttaaaatgtatattaataatggaacccagaatatacagctgtgaagcaaagaaaacatccagcaagccagttcatgcttcacttccatacattctgtgaaagcattttatacactctgaggagctatatattttaagagtatatattttattatttatttcacaggcctcccatgaaggcccatattttgttaagtcttgattttactgacctggaacagcaaaatagttttatcaccatcatctccccatcttggaaaatgtatatacagtctttgatagtggaattatctctacatattccttgcacctaaaaaagaatgtactggtttctctctagaacaatcatcttgagtatgaatccacaacagcctgtagataataaatttatatattttcttatttgcaatttctcctaatcaattatttctgaagaaaacaagatatttacctagatcactattcccttaaataaattcaatatcctaccattgaactactcagattaaaa

SEQ ID NO: 404025 - DNA, 319 bp, Homo sapiens
atgtgaaataggtaggtgtggtaagtcacaaaggcagcactcatttcctgtccccgtggtttaaaggtttgcatcattcatcacaacaaagtggtaagcattgtagcataaaagaccacaaacagtgaaaatctttctatgttattgcactttcccctaagccttctcacctattagctttttccttttgctatgcaaattatttaatataatagaccaccttatctgcctcgattgtgaaataggtaggtggagcttgcattgagccgagatagcaccactgcaatccagcctgggcgacagagcaagactctgtctc

SEQ ID NO: 404026 - DNA, 513 bp, Homo sapiens
gaagcatgtgcagacgaggtggaatgtgactgcagtaataggttcttcactaagtgtgtgtgtgatgcttggaaaagacacagttcaaacactattagaggatcgatctctgctccccatcaatcaccatcttgaccatatttctccgacactcaggatatggtgttttagggagcttcctcattagcattttcagtgaagcactttgtagaaagtgagattgaacgttctttgacttcacaggttggcaaatgtcctgctttgtaactgggcctttctacaaattgctttgccactctgaatttatagaccctgcttcaactaacgtcagctctagcagcttcttgcacctttgctgcctttggcctcagctggaaatgcacttcaatgagctagtggccactcagtttatttcttaagcgtgcactagaatctaacaccatggactttgtttttcaatggactctgttcacttgtcatccagaagccagtgggtttttaccatagaaagct

SEQ ID NO: 404027 - DNA, 455 bp, Homo sapiens
taattcagtggttaccactgagggccccgactgggcttggcgggagaagattccgcagggggttttattgggtctcatgttgccgtcgctccatgggatcgcccaagcctcgtcacctcttcctgtttgtgcatgtgtggctcacacacgtgcacgtgttcagcccaggaggacctcaaaatcaatttaggctgaagggggaaacgactcctcagtgttctcctctcctgggatgggaggggatcgttgcctccgagggaattagatgcagtagccgaactccaggtgtaattccaccactgggcgaagtccaagttcccagaggaagggcatctattgagaattcccaccagaagaccaggggaaatcttcagatgaactggttgttgaagacctgccttcagggcttgcaggaagtggggtacattggctgaaggaattgtgtgaagctgttg

SEQ ID NO: 404028 - DNA, 646 bp, Homo sapiens
ctagtgccgtgcttaggtcacggctgtgtaccccatacagtgtagatgttcagatgcttgaatccagcaaggaatgagtccgtgttttcagtttttggtaagtggaagtaattttagaattgtaatgaaaccatgttaagccacagtaaacagtgttaagacatgtgaccatatacatccaggtgtacagaaactgccccacccaactgcttcttggtgcacgtccttctcatagcctgtgtattttgaggaaataatctatttctttatactttttagaggcctttctggctaagagaataattgcttgccgcataatttcaccagtaacacgcctcttgacagctagtttccctgaaattcatttagcaatttctcaccacctcatgacaaacatgaaatcttaggttaacactaccttctttgtcctatcttctcaatgagattatcttcccttcaggggcattcctgagagccttgtctgtaatatttccttaattatctataatcatcttaaatgattgtgttttttgattttgcacagagcgaagtacctacacattatttcagaagcaccaacctgtttggctctcctgagttcttccagctgggcgtttggaatgtgggtcaccgggtgtgaatgagc

SEQ ID NO: 404029 - DNA, 1064 bp, Homo sapiens
ggatttttggggcttcctgggttgattttaattttctaaaaatcactgaaaaagtaatttttcagtggcacagttttcacttttttcctgatccataaaaccagcaaagtggatacattcagtgttctataactacatttaagatccatgatgttagcttttcctctataaatcaacttaactctcttttataatggtgacacttacaaagctaaaaccccaggaaaattaaagttgatgaaagaaataacagattccccggctctatatacctgggaaatagctggttaagcttcaccacaaaggatagatctaaattgtttctgaaatgtttaaatttcaaaccccgcatagtcaaggataataaaacagactcatctttttttgccctcttgttaaattctaagcttcacaggcatttgaatacatctaaaaaatttggtttgtgagccttagaatttaaccacttacaaaactcttgagctccctccacttctgaggacgtttcctgacacattcaacagcatcagcgtccaatcaggagggagctcaaagagtaatccagctaattctaaggacacaaaggttttctctaggtaaacagtttaggtaaattacaaagtggtaagtttttcttgaggattgaatgaagaaagctactggatattgtgtaaggcagttgagtttctgccttaaacaagtgagtaaaggctcctatggttaagactgatgtgtgttgagagcacatctaacttgataagatcaattgtattgggagtaattaaaacaaatgttgtcctggagtcaaactgtgtaatttaaattttcacatttactaagatatggaatttggatggacttaaatcaagtctttgcgaacaccgatatacatgaactggggtaaggcgtacaaaacttcgaccatcataacacatggcgcatgaaaaatcgaaatacacaggcgacaaaatataaagtaagagagacggagagaactatcaaatgacagaatattactagcacactactacttgatgcgtcttactcctcacttactctcgcgt

SEQ ID NO: 404030 - DNA, 538 bp, Homo sapiens
atacaatgcaactaaatattttaataagcaaaataatgcaaattgctgaaaataaataaattgctttgctatacagctacagttctttatggtattgaaagaataatctatgaagggtatctataatattctacaatattctatataattgccactgaaataattggttccattctcatttaaccatttaaattatatttttcctggaaagtgactaattggttcaatctggccttttgcaatctaaaataataattataaaaacataaaaataacagtacttaagaaatttatcagagatatgagctaaataacataagtctccaaggcaaaatgcatataaatgtgtgtaactggttgatgaaacagagtgagctcattagtgtatgatcaaaaaaactttctcttcaaccattgccttcaaacctgctctctcagaactctcttcccatccataagcagatcccacagctgtagagtcacttttaagagcagcatgatctcagctaaacattcattttcaggtactaaagggtct

SEQ ID NO: 404031 - DNA, 363 bp, Homo sapiens
gaaaacagaaagaccaccttccttttactctactgggttggaagatgagtgagaataccaaaatttgaaattgaaaattgataggaacatgtgacttcagaaatggagaggagtgatggtaaggtcatatccttctgccaagtaccttaggtcttttctgtaaagtggatcatatagaattttgaaagctgagctggggagctgataatgaatactataggcaacagtctgttgccaattcctcactgaggaaatgttaaggaaatagttttatattcatttatttgtagaagaatacattgggagatgataatgctctaagtcagtgaggttggtatggttaattggagggaagtggatgtc

SEQ ID NO: 404032 - DNA, 601 bp, Homo sapiens
accacacccatccccaatggtgaaatcttatatagccatagtataacatctaaaccagaaaactgacattgctctttgtgtattactattagccagtctacagaccttactcagtttttaccatttttaaaaactgcattcatttgtatgtgtgtagttctagttttatcctatgtacaaatctgtgtaaccagcaccacagttaagatacagaatcattccatcacctcgaaatcacagcctcatgctacctctttgtattctcagccaccctcaccctctcccagctcctcaccccgtcttcgtcctctggcaaccactaatctgctctccatctctatagttgtgtcactttgagatgttatgtaaatggaatcacacagtatgtaatcttttgacactggctttttttcactaagcataacactcttgatgtccatctaggttgctgcatgtatcagtagttcattctttgctattgctggggagtattccatggtatggatgtaccagagtttggtcaaccattctcccactgaagggttgtttccagtattttgttgttacaaataaagctgccataaacatttaaaaaaccggg

SEQ ID NO: 404033 - DNA, 507 bp, Homo sapiens
gaagacgatgctcttgatgtctgcccctcgcaaggtgatctgtgtttgcctccagccatggccaccatttcttccccacagggctgctccgtgggcaccgtgttttctcacaaacacctggagtgtgccagagtgcagccccgtcaccttgtgcctgaatgacaggcacaggtcccctgaatgcatgaggcggccgagaggtagcaccaagcgtgcagcttttccccctggggctttggctgccgacactgtcagatattgtccacctgctgggtccctgattggttcccagtgcaagtcattgtctttctccctgatccagccacaatgtgccagttgcaatcactactgtctgctgctcacaagccagccgggctcccctttgccttcagtccccaagtccacgttcctcaggacttccacgatccagctccacccacagcagcccctctgaagggcgccctgttttctgtaacataccagcgtctccatcatcaccaccatgtg

SEQ ID NO: 404034 - DNA, 175 bp, Homo sapiens
gcttgaactagcttccactaattatagggtcagtgacaataatggctaacactcacagccaccgactgtgtgctagatgtggcgctgtgagtcctcacaacccgaggaagtgggtattatgataatcatcatcttttttttttttttttttgagatggagtctcgctctgtcact

SEQ ID NO: 404035 - DNA, 496 bp, Homo sapiens
ttttcagctttgaaagaattacggctggaggacaacttgctcacccatcttccagagaatttggattccctagtgaatcttaaggttctgacactgatggacaatcccatggaagaacccccaaaagaagtgtgtgctgaaggcaatgaggccatatggaaatacctcaaggaaaacagaaacaggaatataatggcaacaaagattcaggcatggtggcgtggaacaatggtacagagaggatttgggaaattcggtgaactactaaaaccacaaaagaaaggaaagacctctccaaaagataagaaaggaaagaaggatgtaaaaggaaaaccaggaaagggaaaaaagaaataatcctgtaaattgataaattggggtaatggaccttgatagattaagaagacaaaatatctaggaattagatgcctactacattaaaattattcataaaattacacttatgtgtaaaaataaatgattcttacttttactg

SEQ ID NO: 404036 - DNA, 618 bp, Homo sapiens
tctgacaaattgaacattcatgtgtttattttgtactgtctcttcctcactggaatgtgagctccataaagttgagacagttatttctctgctgttgcccaaaagtctagaacaggcactggcacataaaaacaataaatgcattttttaaaaaatttgtctgaatgcctagccaattgagaaagatagaaaataaaatttagagttctaatcacatcccattctctccacgtcttcaagaccatgtatcagaataaagagatttaacaatttccagttcattgtgataccagccgatgctgaatttgggtttatcttgttttcagattcaggcatggtggcgtggaacaatggtacagagaggatttgggaaattcggtgaactactaaaaccacaaaagaaaggaaagacctctccaaaagataagaaaggaaagaaggatgtaaaaggaaaaccaggaaagggaaaaaagaaataatcctgtaaattgataaattggggtaatggaccttgatagattaagaagacaaaatatctaggaattagatgcctactacattaaaattattcataaaattacacttatgtgtaaaaataaatgattcttacttttactg

SEQ ID NO: 404037 - DNA, 441 bp, Homo sapiens
atctttgtagataatttttcataatctaaaaccattgcaatgggaaattttcttttgctaaatctagtgctgtgagtaaattacaaagcatatgtattcaaagatatgtttttaatgtaaccagattttttccattttaagtattcatgaaaaattttggccaggtgcactggctcatacctgtagtcccactactttttgaggccaaggcaggtggatcacttgagcccaggagttcaagaccagcctgggcaacatggcaaaaccccatctctacaaaaaaaatacaaaaattagctggacgtggcagcatgcgcctatagtcccagctacttgggaagctgaggcatgaggatcgcttgagtctgggaggtggaggtttcagtgagcccagatcacaccactgcactgcagcctgggtgacagaatgagaccttgttc

SEQ ID NO: 404038 - DNA, 4126 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 404039 - DNA, 918 bp, Homo sapiens
  misc_feature (1)..(1): n is a, c, g, or t
  misc_feature (48)..(49): n is a, c, g, or t
ntctagaccatcgctttatggttgtgggtagacatcacccgcaccagnnctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagaaaaaaaacgcgcaaaccagcgaacacagcagaagaagtcacgacgaacacaccccggggggcaaaaacgaggggcgcgcggcaacaaagcgggtaagacagcgggacacggggcaaagaggaggcagagcgccagcttgtgcgccaacggggggggaaactcggggaggccccaaatagagggcgaagaaaactgcaaaggcggggacgcgtaga

SEQ ID NO: 404040 - DNA, 1621 bp, Homo sapiens
gcacacgcctgtaatcctagcactttgggaggccgaggcaggtgaattgcctgagctcaggagttcgagaccagcctaggcaacacggtgaaaccccgtctctactaaactacaaaaaattagccgggtgtggtggcatgcacctgtagtcccagctattcgggaggctgaggcaggagaatcgcttgaacccaggaggcagaagttgcagtgagctgagatggcaccactgcactccagcctaggcaacagagtgagactccgtatccaaacaaaaaaaaagtttgaaccatctgcattatgggccttgctccagaagtgtgactggggctttcccagattgaaaagccagttccaaaactctgttaatgaaagaaccaatgcatctgagtggataaatgtttctaaaataaaatagttcttgttaaagtgaaatttgaaaccacatgttaaatcaaaatgatcctttaaattagtatcactggtttttcatacctggaatcacatttcatgatacatttgggtgggtcctccctgcaaattttcaatgtttattcccaaagtcaaactcccattcatgtgaacaatacaggttagacagaggtaaggtcacattttacattacaactttgcaatattaatcaacctagtactttaaaggaatgattgaaaactatttgggaagataaaaaccagtttcaatgaagcaaacctattcctcatgaaacttaagatcagtcattttatcttcaatccacatttaatgaacaccaaccatgttgattaaatgcctactatgaccctgacagccacagtgcatctgacacttactttctccaaaacaactatgatttaaaccttgagtaaatcacttgaaccttgaggttagagttactatatttgctcaagatgacaaatgcaggtgctttcttttttaaagaaaaatgacactagatcattaacaccttgagtataggacaggtaattgcctctgtaattcccagcgtctagtgtagtgcctggtccatagaaagctctcaataagtgtttgattacatttaatctcagagctcccttccaagggatactgccaagaggtaaagctccaaacctctactcttactgagagcagaatttcttagaatttccagaaccatctcctatgcttaagtataaattcttgtcagacacagtggctcacacctgtaatcccgctacttgggaggcagaggtggggggaatcagcagaggtcaggaggtcaagaccagcctgggcaacatagtgagacccatctctaaacaaatgtttaaaaattagctaggcatgctggcacacacctgtagtcccagccatttcagaggctgatgcaggaggatcgtttaagtccaggagttcaaggctgcagtgagctataatcatgccactgcactccagccagggagacagagcaagactcagtctcaaaacaaacaaacaaagagactggaggacgaggctggtttctccaaagctctttaaacctctgtttgggtgtgggtgcccaggcctgtaatcccagccttggaaattagggattgtggttaagccgaggtataacagccggacatttaagcccttttt

SEQ ID NO: 404041 - DNA, 8598 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404042 - DNA, 8519 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404043 - DNA, 4538 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgaaaaaaaaaaaaaaaaaaaaaaaaaaaaaaaaaaaaaaaaaaaaaaaaaggggggggccccaaaaaaccccccgagcgagcgcgccacaaccaatacaagcgggacacagccacggcattcaatggtagaacaaggggtcgccccaataggagagagccccccagccaataataacagcgaccggcgccaacgaggagccgggagataaaacaccaaggacaacaagtgcgcaaaccaccgggcgccagccgggcggcactatgaggcgagcagacacccacactacccctggggcggcgggcgcacaattcatgggtgagaaacaactcacccaacaaaagacaagaatacaaagccctcgaaaggagcgcagtactaccacaatcgcaggaccgacaaacaggcgggc

SEQ ID NO: 404044 - DNA, 8202 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggttaatggctgctcctggctagatcacaggaccctgcatgatactggaatgctccctggtgaggtactgcagagttacaggatcgtgaactctatttattcccacatcaatgactgctgctccttccttgatcatatctgctgtgatcagatttggaatacctggaaatggagaaaggaaagatcaacttagtactgaaaacagtctacctgtcagattcttgtctaacttcaatttcaagagaccctgaagaactaatcaacatgttttattaaaacctgttaaaaatattaact

SEQ ID NO: 404045 - DNA, 8681 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcaggtgggcctggatggctgggtagaaggtgtggggagagttagtgaccagtgtggggcttttacttctgcccttggctcctgcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404046 - DNA, 8508 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404047 - DNA, 8484 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404048 - DNA, 4111 bp, Homo sapiens
  misc_feature (4068)..(4068): n is a, c, g, or t
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccaccccaagttagtgngcctgttgggattccctgatagattgtcctgaaaaaaaaaaaa

SEQ ID NO: 404049 - DNA, 3952 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctagtgcttcagtgacctcggggagtcctcta

SEQ ID NO: 404050 - DNA, 8154 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagttctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggttaatggctgctcctggctagatcacaggaccctgcatgatactggaatgctccctggtgaggtactgcagagttacaggatcgtgaactctatttattcccacatcaatgactgctgctccttccttgatcatatctgctgtgatcagatttggaatacctggaaatggagaaaggaaagatcaacttagtactgaaaacagtctacctgtcagattcttgtctaacttcaatttcaagagaccctgaagaactaatcaacatgttttattaaaacctgttaaaaatattaact

SEQ ID NO: 404051 - DNA, 4036 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 404052 - DNA, 3691 bp, Homo sapiens
  misc_feature (3448)..(3448): n is a, c, g, or t
  misc_feature (3451)..(3451): n is a, c, g, or t
  misc_feature (3454)..(3455): n is a, c, g, or t
  misc_feature (3457)..(3457): n is a, c, g, or t
  misc_feature (3462)..(3465): n is a, c, g, or t
  misc_feature (3468)..(3468): n is a, c, g, or t
  misc_feature (3470)..(3470): n is a, c, g, or t
  misc_feature (3476)..(3476): n is a, c, g, or t
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagccgcacatgagaaggtcactttgcccatgtagactggtnacntgnngntcccnnnngcncngagganggctgatgaagggaaggtggcaaagtcagtgggtactgtgaccttctcatgtgcggctggttttggacagcgacaccggctggtgctgacccaggagcagctgcaccagcttcacagtcgcctcatctcctaagcaccctctgtgcagtccacctcctctgtgctgtcacagaagctgaagccgggaggagtgggagccccctcctctgtgctgt

SEQ ID NO: 404053 - DNA, 6894 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404054 - DNA, 3089 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctctgcctcctaacccatacccctactcaggttctcttatagtg

SEQ ID NO: 404055 - DNA, 5203 bp, Homo sapiens
agtgactctagagtgatctcccccgactagccctgacagcacacactgcacgtatgtagacatcactcgcaccatgccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404056 - DNA, 5206 bp, Homo sapiens
  misc_feature (231)..(231): n is a, c, g, or t
  misc_feature (234)..(234): n is a, c, g, or t
  misc_feature (237)..(238): n is a, c, g, or t
  misc_feature (240)..(240): n is a, c, g, or t
  misc_feature (245)..(248): n is a, c, g, or t
  misc_feature (251)..(251): n is a, c, g, or t
  misc_feature (253)..(253): n is a, c, g, or t
  misc_feature (259)..(259): n is a, c, g, or t
gcggccgcctactactactaaattcgcggccgcgtcgacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagccgcacatgagaaggtcactttgcccatgtagactggtnacntgnngntcccnnnngcncngagganggctgatgaagggaaggtggcaaagtcagtgggtactgtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404057 - DNA, 896 bp, Homo sapiens
agattggtactggtggtcgttcttacaagcgtcgatgactggaacaaccctgtgcggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctccccacagctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 404058 - DNA, 1736 bp, Homo sapiens
  misc_feature (1667)..(1667): n is a, c, g, or t
  misc_feature (1684)..(1685): n is a, c, g, or t
  misc_feature (1692)..(1692): n is a, c, g, or t
  misc_feature (1714)..(1714): n is a, c, g, or t
  misc_feature (1727)..(1727): n is a, c, g, or t
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcanttaaatggaattaggcnntgggggnggccagccaattgaaaattttnctttttgaaaacnttttcttta

SEQ ID NO: 404059 - DNA, 1951 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggtatggccaatcaatcacatgttccacagaaatctagtgaacttgccatgaaccaggcattgaagatgctgagtgaagacaacagagtctctgcccacaaagagtttatggtatagtggaggaacacagcaaagt

SEQ ID NO: 404060 - DNA, 1143 bp, Homo sapiens
  misc_feature (65)..(65): n is a, c, g, or t
aagtaacaatgtaaaaaaatcacaatccaaaacataagtccaatataaagtttggagcagtttgnaggtcctctaagcccttgaaccaggtcaatgcaaactaagagtttggggggaagaaggcaggtcaggagcatttctcagagtaattaatcaacagggtgacattcgtggagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404061 - DNA, 639 bp, Homo sapiens
acggagtcttcctctacatgggcgtggcctccctgaatggcatccaggtaaggctttccctccagatcccttcatgatctggagtcaacattccatgtctggttccatgtcaccaagacccccaattcagttgtcccaattgtccccaattgtcctaattcaatgaaagaataatagtaataatgatactaccacttactgatgctatcaggcaaaataaatatgttaggcacttcataggcctcatataattgaatctatgtaattaggtcctctgatccccattttacagatggggaccggagggtcagaattcaaaatccagaagaagctgactccagtgagcatttcactgtacctctctctcttccctaaggcagctatgcagaagaaaacatttttgttttgttctgtatttactgtgaaatcccagaattcttaaacagtttgtgttacaattaacttgcactttccctgaatatggacaatgtccattttgtggccagctccagggctcctcccctcacccagggctcaggaccctttctctaagaccccattatgcatccgcctagacacctccagcccccctcccgtgcatccttaaggcctgagcagggggcttcccctctctgagac

SEQ ID NO: 404062 - DNA, 237 bp, Homo sapiens
tgaataaaactgccccctccacttggcccagggatttagcccctgctcaggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctcccca

SEQ ID NO: 404063 - DNA, 543 bp, Homo sapiens
cttgcagagctactgctagttgtgggaggacggggagacaggaggaaggcatctggagagcaccatcctgcctagaaggcagggttttccctgtaactggatctctctgtaaggagcacagtgatgatctcttctctccaccctcactttctcaccccctaccgaccattccttagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaagtcaggcactttccctggggccttgcttcctctaatcctcccactgctggagctctctgcctcctaacccatacccctactcaggttctcttatagtg

SEQ ID NO: 404064 - DNA, 4971 bp, Homo sapiens
  misc_feature (4178)..(4178): n is a, c, g, or t
  misc_feature (4180)..(4180): n is a, c, g, or t
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgaaaaaaaaaaaaaaaaaaaaaaaaaaaaaaaaaaaaaaaaaaaaaaaaananaaaaaaaaaaaaaaaaaaaaaaaaaaaaaaaacaaaacaacaaaaaaaaaaaaaagaaaaacagaaaagaaaagaaagacagacaaaagaataagaagagagatgaagaaaaccgacaacgaaggggggagaccgagagaacaaatgatagggggaggaagcggggcggagaaaggagagacggggggagagcgacgggaggaagaaggcgacagacaatagtcgcgcgggagcgacgacgctgcagggagtaagggcagagaagaaggagggacgaggcgacaaggaatctgcagacaggggaacgcgggacgggcgggagagcagagagaggaagacgacgagacaggggcagacgacgagggggggggcggaggcagggggggagcgcagcgggcagccgcaggggggagcgagggaagacacagagcaaagacgaggacgaaggcgggagggaagggcaggcagacggcgggggaaagagagaaggagaagagcagagggcgggcggggaagcgagagagagaagcagagacaacagaaagacggcggcgacaccgccggcagaacagggagggacacagaagcaagagacaccagacccagcacggagagcagagaacgaaacgggccaagaccagcacaaggcgaaagggagacaagggcacgaaagcaggaggacggaggagggagaagggggaggggacagcagcgggccgggaggagcgggcgggggacgagagagagagagcacgacacggagagcacagaagaacgaaacaaccagagcg

SEQ ID NO: 404065 - DNA, 8761 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgacaccatacccagctaatttttgtatttttagtagagatggggtttcaccatgttggccagcatgatctcgatctcgacctcatgatccgcctgctttgacctcccaaagtgctgggattacaggtgtgaaccaccgccgctggccgaccctgcctttctttagcccaaactatggtgtggtgtcctaggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404066 - DNA, 7419 bp, Homo sapiens
tcagctggtcccaccgcggttatgggatatcgtcgacccacggcctcgattgatgagctcgaacgagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404067 - DNA, 8614 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcacaccggcagtcccctgcctgtcgagttgacggatcagccctgtgatcagctctggcagatctgcatcgacatgagccacctgccatgtagaaaccagctttatgaactctatgaggcggactgtgtcatcctcggctacccaaagcccggattcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404068 - DNA, 4196 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtaaaacacacacacaacacaaaccaaaaaaaacccgaaaaatttctccccacccccccttggcccaaatg

SEQ ID NO: 404069 - DNA, 4923 bp, Homo sapiens
  misc_feature (4130)..(4130): n is a, c, g, or t
  misc_feature (4132)..(4132): n is a, c, g, or t
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgaaaaaaaaaaaaaaaaaaaaaaaaaaaaaaaaaaaaaaaaaaaaaaaaananaaaaaaaaaaaaaaaaaaaaaaaaaaaaaaaacaaaacaacaaaaaaaaaaaaaagaaaaacagaaaagaaaagaaagacagacaaaagaataagaagagagatgaagaaaaccgacaacgaaggggggagaccgagagaacaaatgatagggggaggaagcggggcggagaaaggagagacggggggagagcgacgggaggaagaaggcgacagacaatagtcgcgcgggagcgacgacgctgcagggagtaagggcagagaagaaggagggacgaggcgacaaggaatctgcagacaggggaacgcgggacgggcgggagagcagagagaggaagacgacgagacaggggcagacgacgagggggggggcggaggcagggggggagcgcagcgggcagccgcaggggggagcgagggaagacacagagcaaagacgaggacgaaggcgggagggaagggcaggcagacggcgggggaaagagagaaggagaagagcagagggcgggcggggaagcgagagagagaagcagagacaacagaaagacggcggcgacaccgccggcagaacagggagggacacagaagcaagagacaccagacccagcacggagagcagagaacgaaacgggccaagaccagcacaaggcgaaagggagacaagggcacgaaagcaggaggacggaggagggagaagggggaggggacagcagcgggccgggaggagcgggcgggggacgagagagagagagcacgacacggagagcacagaagaacgaaacaaccagagcg

SEQ ID NO: 404070 - DNA, 4050 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 404071 - DNA, 7911 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggttaatggctgctcctggctagatcacaggaccctgcatgatactggaatgctccctggtgaggtactgcagagttacaggatcgtgaactctatttattcccacatcaatgactgctgctccttccttgatcatatctgctgtgatcagatttggaatacctggaaatggagaaaggaaagatcaacttagtactgaaaacagtctacctgtcagattcttgtctaacttcaatttcaagagaccctgaagaactaatcaacatgttttattaaaacctgttaaaaatattaact

SEQ ID NO: 404072 - DNA, 3341 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttttgtgcataccgggatcatctagaac

SEQ ID NO: 404073 - DNA, 5321 bp, Homo sapiens
aatgggccagagtatgtataggtcggctgggttaattcgtacgaggtgggctgtacattaccatctccggcatgagaacacgcatctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404074 - DNA, 5368 bp, Homo sapiens
agattggtactggtggtcgttcttacaagcgtcgatgactggaacaaccctgtgcggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctccccacagctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404075 - DNA, 5174 bp, Homo sapiens
  misc_feature (1)..(1): n is a, c, g, or t
  misc_feature (48)..(49): n is a, c, g, or t
ntctagaccatcgctttatggttgtgggtagacatcacccgcaccagnnctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaagcactcctttcccctgctgtccccttcgaccctcagccctctggtgccgctctgcccgatgcacagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcagtgcttcctgtgtggtgttgagagtgggacttgggccattaagctcacagcaggagtggaggagaagcgatgctgaggaagctttggctgtatcaaatttgaggtctcctcttcgtagtgaccagaagaatgctgtttctaaaattcatgtgcacaggcatcccaggatttggaattcagctgtgagctcatgagctgatggatgtttccaggagtaccctgaagaccacccaggtgggagtgtaagataaccttccagataaagagttgctgctaccaaaagagtgctgacaccatcacagtatgttcccttctcaaccctggacatggttcagaaacagctaaagcagacaagaatctggggcagccaatattgtaccacctgccaaagcttggcacaaacaatctggaagccaaaaattgcacatactgtggaacagagcaagtggttctggcctccctgggatttggatcctggtttccagagctaagaacacaaagtcatgaaggtgaaggaggagaaggctggggtaggaaagctggaccacactaaccacaggaggagatttccggatcagaaagaatgccctcctatccacattgggcttccagtacccacttaccctcaaagaaaaactgaccagaagggacatctttcaggcctgcaaaaagtccactggggcctgcggccagaccagccacagcaggaactgactggcccagggagtggggcaagcagccaggacagcagcatggatcttatcagcaggactcggtccccagctgctgagcagctccaggacatcctgggggaggaagatgaggctcccaaccccaccctctttacagagatggatactctgcagcatgacggagaccagatggagtggaaggagtcagccaggtggataaagtttgaagaaaaggtagaggaaggcggcgaacgctggagcaagccccacgtgtccacactatccctgcacagcctcttcgagctccgtacctgcctgcagacggggacggtgctgctggatttggacagtggctccttaccacagatcatagatgatgtcattgagaagcagattgaggatggtctcctgcggccagagctccgggagagggtcagttacgtcctcctgaggaggcaccgccaccaaaccaagaagcccatccaccgctccttagctgacattgggaagtcagtctccaccacaaatcgcagtcctgcccggagccctggtgctggcccgagtctacaccactccacggaagacctgcggatgcggcagagtgcaaattacggacgtctgtgtcatgcccagagcagaagcatgaatgacatttctctcaccccaaacacagaccagcggaaaaacaaattcatgaagaagatccccaaggactcagaagcgtccaacgtgctcgtgggcgaggtggacttcctagaccagccattcatcgcgttcgtgcgcctcatccagtcggccatgctgggaggagtgaccgaggtgcctgtccccaccagatttctgtttatactactgggaccttctgggagagcaaaatcctacaatgaaattggccgtgccattgcaaccctcatggtagatgatctcttcagtgacgtggcctacaaagcccgcaatcgggaagatctgatcgcaggaattgatgaatttctggatgaggtcatcgtccttcctcctggagaatgggacccaaatatccggattgagccccccaagaaggtgccctctgctgacaagaggaaatctgtgttctccctagcagagctgggccagatgaatggctctgtgggaggaggcggcggagctcctggaggaggcaatggaggtggtggtggtggtggcagtggcggcggggctggcagtggcggggccggcggaacaagcagcggggatgatggagagatgccagccatgcatgaaatcggggaggaacttatctggacaggaaggttcttcggtggcctgtgtctggatatcaagaggaagttgccctggttcccaagtgacttctatgatggcttccacattcagtccatctctgccatcctattcatctacctcggctgtatcaccaacgcgatcacctttggtgggcttctgggggatgccaccgacaattatcagggagtgatggagagcttcctgggcactgccatggctggctccttgttctgcctcttctcgggacagcctctcatcattctcagcagcacggggcccatcctcatctttgagaagctcctcttcgacttcagcaaaggcaatggcctggactacatggagttccgcctctggattggcctacactcagctgtccagtgccttatcctagtggccacagatgccagctttatcatcaaatatatcacccgcttcaccgaggagggcttctccacccttatcagcttcatcttcatctacgatgccatcaagaagatgatcggtgccttcaagtactaccctatcaatatggacttcaagccaaacttcatcactacctacaagtgcgagtgtgtcgcccctgacacagtgaatacaaccgtgttcaatgcttcagccccattggcaccagacaccaacgcttctctgtacaacctccttaacctcacagcgttggactggtccctgctgagcaagaaggagtgtctgagctacggcgggcgcctgcttgggaattcctgcaagtttatcccagacctggcgctcatgtccttcatccttttctttgggacatactccatgaccctgaccctgaagaagttcaaattcagccgctattttcctaccaaggtccgggccctggtggctgacttttccattgttttctccatcctgatgttctgtggaatcgatgcctgttttggcctagaaactcccaagctgcatgtgcccagtgtcatcaagccaacgcggcctgaccgaggctggttcgtggccccctttgggaagaacccgtggtgggtatacccagcaagcatcctgcccgccctgctggtgaccatcctgatcttcatggaccagcagatcactgccgtcattgtcaaccggaaggagaacaaactgaagaaggctgccggctaccatctggacctgttctgggtgggcatcctcatggctttgtgctcctttatggggctcccctggtacgtggctgccacggtcatctccatcgcccacatcgacagcctcaagatggagacagagaccagtgcccctggggagcagccccagtttctgggagtcagggaacagagagtaaccggcatcatcgtcttcatcctgacgggaatctctgtcttcctggctcccatcctaaagtgtatccccctgccggtgctgtacggagtcttcctctacatgggcgtggcctccctgaatggcatccagatggggaccggagggtcagaattcaaaatccagaagaagctgactccattctgggaacgctgcaagctcttcctgatgccagccaagcaccagccggaccatgccttcctgcggcacgtgccgctgcgccggatccacctcttcaccctggtgcagatcctctgcctggcggtgctctggatcctcaaatccacggtggctgccatcatcttcccggtcatgatcctgggcctcatcatcgttcgaaggcttctggatttcatcttttcccagcacgacctggcctggattgacaacatcctcccagagaaggaaaaaaaggagacagacaagaagaggaagagaaaaaaaggggcccacgaggactgtgatgaggagccccagttccctcctccctcggttataaagattcccatggaaagtgtccaatcagatccccaaaacggtatccactgcattgccagaaaaagatcttccagttggagttactcactctgattcttccttcagtgacacagaacttgaccgaaggtaagcaggcatggattagagacataagctatacgtcacttacaaaaacatctccagcaaactatctaaacttctttaaactccagagaactatcaaaagaataacgccagctggcagaagaacgaggacggaggtaggtcaactcaattgtttcttctctttctgcctcaagctgcctagagcaggagctacttctgctcgcatgaaagccaaaagccaaaacagacaaacctatccctgcctcaagtattttacagattaagctcctagcttggcacaacctgttgtgatataagactgtaggacaggccaggtgcagtggctcacgcctgtaatcctagcattttgggaggccgaggcaggtggatcacttgaggtcaggagtttgagaccagcctggccaatgtgatgaaaccccatctctactaaaaacacaaaaattagccaggcatggtggcatgcacctgtaatcccagctactcaggaggctgaggcacaagaattgtttgaacccgagaggca

SEQ ID NO: 404076 - DNA, 2422 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagccacctcagccagcccccaggtagaaacgtgggttaagctcttcctgccccgttcagcttcactcccaccctttcagcgtcctgccccttcaccttgacccgggttcccccactcccattccctggcctctgccataatttgttgttcaactgctccctccttcctgaggggcctcagggcttgtggggggtaggctgagaccccaccaccaaaggttaagtgaggtccccttgattgaggacttcaccccttgattaaagcaacttctgcttcag

SEQ ID NO: 404077 - DNA, 1497 bp, Homo sapiens
tgggcgtcggtcgtcggtggggtcggagctgggcgcggagcccctcacagtgcagacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgtttggtttgaaccgtgaacaaaactgtgttttgagtttagctgacattaaagaaaaaagttcatcacgtgactgttaatgtaaacctggttattaaaataactatgaaattac

SEQ ID NO: 404078 - DNA, 619 bp, Homo sapiens
agattggtactggtggtcgttcttacaagcgtcgatgactggaacaaccctgtgcggtggttcccccaccacagaagctcttcccagcagtgttctttggcttcactgttcagtttgtttgattcacccactctctctcaagtacttgttctgttagagagtcttatacctgcacccctaacccttaatccagtagaactgcctgcctgcgccttggtgggcctcaccagctttctctccccacagctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagcgttatcagacaggaaatagccacgtctacgatgaacgacttcgagctcggatcccttgagcttcgtccgtataagctctaatgggatctctagagtc

SEQ ID NO: 404079 - DNA, 501 bp, Homo sapiens
ggaacaggactcgaaactaggtctgctccaagcccagtctgtaacaccacccaatgctggtgctctttccatgctgggtgagaaccctggagggacctgaaccaaggcgagggcacagggccagtggaaagaaggtcccaaacacgtgggaccttcttttccgctgatgcaacatggatccagctgaaggaggcttttaataagaagttcccattttccacctatcagatgagcaaatatccaaaagttcactaataccatcagttggcaaggctaagaaacaaggacattcctggtggagtgtaaatgggcaataatctgtgaacattccatattagtctatccttttgctcggcaattttgcttctgggagtttatggaacagagatagctacgcagaactaaaagaccacatacacaaggttatttatgaaaacacaggccccagcacccattaaatactgggctgattaagtaaactaaggtacattgatacactag

SEQ ID NO: 404080 - DNA, 365 bp, Homo sapiens
gtgccctgagcggtttattagcaactaaatctgtgtgaaaggagccaggcagagctaacgaccacttccacttgtgaaccactcaattttgtgcatttagtctgtctggtgtttagaaatgaggaatctagcagcaatcagagtgggacaggggccatgctgggacacagaaaggggctggcaaatatcgcggaatcaaaacaagagcgagagaatggagtacctacttcacacctgatctcagttaatttgcacctcaagcctatcaggccagcattacttccattttacagaaaaaaaccaaggctcagagagatcaagtaatttgttaaggtcatgcaagccagtgtgggaaagtcacgaaa

SEQ ID NO: 404081 - DNA, 506 bp, Homo sapiens
tagattaatattattctagttctcaatactggcaacttattacctgggagcattctcagaagtatcaatcctttaccaatgcccccacctcttcactccaatcccccaactcccttattttgatcccattagtctgggggtgagataacaacacctgtgtttttttaatgccccagatgacgacacctgggaagagagaggcggatttgtaggtaacaatgcaacagggatcagggaatggcaggaattccctgcatgggtacacaccaaggctgtcacaggtggtggaacaaatgagagagcagaggccacagctaaatcacctcccaggcaggactggcatccaaaccctcttccaacattcagacatctataccaagagcaaagatcctgtcgttcaaagtgtcacctctcatctgccatcacccagtgtcccacccataacatcagccccgtgaactattgccagaagcaggagatggcagtttctttgctggcatttgtag

SEQ ID NO: 404082 - DNA, 328 bp, Homo sapiens
atgttgcaacttcactcctcacagtgtggcccacagacgagcatcatcagcatcacccgggagcttgttaaactgcagcatcaggccacatccagggcctgagtcagaatctgtattttgacaagatcccaagtgattcgtgtgcatactagtttgagaagctttggggaccacagtttcactaatggttttttttttttaatttcttttgagacggagtttcattcttgttgcccagggtagagtgcaatggcgcagtcttggctcactgcaacctccacctcccgggttgtagagattctcctgcctcagcctcctaagtagctgg

SEQ ID NO: 404083 - DNA, 1136 bp, Homo sapiens
atgcagggccgcgtggcagggagctgcgctcctctgggcctgctcctggtctgtcttcatctcccaggcctctttgcccggagcatcggtgttgtggaggagaaagtttcccaaaacttggggaccaacttgcctcagctcggacaaccttcctccactggcccctctaactctgaacatccgcagcccgctctggaccctaggtctaatgacttggcaagggttcctctgaagctcagcgtgcctgcatcagatggcttcccacctgcaggaggttctgcagtgcagaggtggcctccatcgtgggggctgcctgccatggattcctggccccctgaggatccttggcagatgatggctgctgcggctgaggaccgcctgggggaagcgctgcctgaagaactctcttacctctccagtgctgcggccctcgctccgggcagtggccctttgcctggggagtcttctcccgatgccacaggcctctcacccgaggcttcactcctccaccaggactcggagtccagacgactgccccgttctaattcactgggagccgggggaaaaatcctttcccaacgccctccctggtctctcatccacagggttctgcctgatcacccctggggtaccctgaatcccagtgtgtcctggggaggtggaggccctgggactggttggggaacgaggcccatgccacaccctgagggaatctggggtatcaataatcaacccccaggtaccagctggggaaatattaatcggtatccaggaggcagctggggaaatattaatcggtatccaggaggcagctgggggaatattaatcggtatccaggaggcagctgggggaatattcatctatacccaggtatcaataacccatttcctcctggagttctccgccctcctggctcttcttggaacatcccagctggcttccctaatcctccaagccctaggttgcagtggggctagagcacgatagagggaaacccaacattgggagttagagtcctgctcccgccccttgctgtgtgggctcaatccaggccctgttaacatgtttccagcactatccccacttttcagtgcctcccctgctcatctccaataaaataaaagcacttatggaa

SEQ ID NO: 404084 - DNA, 538 bp, Homo sapiens
gccccttttattcctgacacctcagcattctgtagagcggtacgcagaggcgacttaagattccccaaacatgtagatgtgggttgcctagagtggccatcaattaaaccctcctcagcaatagaccgcaaatgggtaagtaagaggttccagggactccctatttttacttttaggaagggactacgagacggcgtgaagacaaaatactgcccaacagagatgggtcagagaggtctccagacagcaagacttagttggtctccacttttcccggggcttaaagtgagttagatgtaagtcatcctaccttctggtacattttaaagtaaaaaatgagatgggtgggccaggacaacatcacttcaggacaggaagcattaagatccttccattcaagccccccacatatggactccttgctcaccaagtgaccatctcattctcctacacagaacacctgggtaaggacaggtatttgggcagaatgtccagtgggagccttggagcaagcggcagcaggaaagtagacaggagt

SEQ ID NO: 404085 - DNA, 352 bp, Homo sapiens
gtggagggagcctggaggggttggtctgccacaccaaatgctagggaggactcggaagcaaagaaacttctgatctggtcatttggaggtcaaagatgctatgcatggagtcaattaagcaggcaattgattggccctgtttctccatctgagaattgaagggcttggataagaccagaaaaggcacaaggtgcatcttgaaagagcagccatgcatcacaccgcctgcctgagtactgtgcctaaagccatacctcagctcactgggaaaggaccccacagtggatcagcaacgtctgccttgggcaagtcgggcaagagtatctcatccccggagcacattgtttctaca

SEQ ID NO: 404086 - DNA, 1042 bp, Homo sapiens
gggtggaagtcagtacatcccccacccccagattgatgtctcaggggctttggccccccttctaggtctagagccagattggggctgaggtggaagtaacatggagcttggttccctgagaggggctgggagctttttggaggggatatgagggtccatgaagctggtggctgggtcacctgggttccaaaggaccctgggccttgcaggagaccttgtgatctggattctctagaagggtgaggataatgggttgaacacctagattcccaagagagcgatggtgctctggggtctctggaaggggttgtcaaaggctgtcacttttaaatggaacaggggctgttggtgctggtctgtgaacagctggaggtcatatccctggcaccctgaggggctggtggaaggctgggatatatctgaatggggcagggactccgggggctatgtggtactgcagcccagtctgggcaggagttgggggcctacagtgagctctggatttggagggggtggtccctgtgggagcaggaactactgattccctggattcccaaggggaaggatcccttgttggattccagacttgggtggagtctttgagggtggatgtgttgcctggaggccttgttggtacctgtttgagctggggccaagggaggcggattgacccctgcagcctgactggatttgggagccgcccatctttagctggccaccttggccttctctctctagtggcaccagggaccctgctctgcctccccactccttcccttcctcccctttccctcctcccacccctccattaccggctgcctggtgctgaattattgatggcccctgttgttgggaaatgacaacaaccgcagtcctcttcctctcttcatctgtctgctcctcctgttgctcgtcttccaacactgctctcttgtgttctatatctctcttttttatctcctctcctatacttcaccttttcgcttaacgcatattattatcactcttcgacgcattgtcatacctccatttccttatcccg

SEQ ID NO: 404087 - DNA, 676 bp, Homo sapiens
gggtggaagtcagtacatcccccacccccagattgatgtctcaggggctttggccccccttctaggtctagagccagattggggctgaggtggaagtaacatggagcttggttccctgagaggggctgggagctttttggaggggatatgagggtccatgaagctggtggctgggtcacctgggttccaaaggaccctgggccttgcaggagaccttgtgatctggattctctagaagggtgaggataatgggttgaacacctagattcccaagagagcgatggtgctctggggtctctggaaggggttgtcaaaggctgtcacttttaaatggaacaggggctgttggtgctggtctgtgaacagctggaggtcatatccctggcactccttcccttcctcccctttccctcctcaccgactaccgcgccccccgacgcagccaacgcagaactctccaccccaaacgcgttgatagccatcggggcgtagggcacgtcagcgtgaggagggcacgcgagctgacagcagcgagcacacggcagacgactatggcaccaacgcgtatgcaccagcccccccacccacagacccgcactacacaccctcccccgcgccctcccacaccacccccccccaccacacgagaccccacccaccaaccaacaccactcac

SEQ ID NO: 404088 - DNA, 378 bp, Homo sapiens
tgaaggcaggggtcatgtttggcgtctgtcaccctttgcgagttgcaacctggagaccctggaggatgttatgatgagtgaaataacctaatcacaaaaggactaatactccacaaattcacttatatgaggagtctaggagtcaaattcctagagactgaaagaacggtggttgtcaggggctggggagaatggggagttcatatttaatgggggcagagtttcagttttgccagacaagaataacctggaaatggatggtgtgatgtttgcacaatgtgaacgtactttactccactatacacttgaaagtgggtgcaatgggaaagtttatttgatgagttttttaccacaattaaaaatataacaaaataagca

SEQ ID NO: 404089 - DNA, 274 bp, Homo sapiens
aaaggaaatgaagaacacatggcctagagcaccatgctgctcatcctggttagacacaactgcaagcacatcagctttgctctccacactgagtccccaacgttctcactgcaaagaactctcaggcttgcttctctgaaaaatacaattgctggcaactcaagatgcacaaagcaggaccatttattgcatctcttatcaaggcatatctgatgacaagtcagccttactcagcaaaatctcattacagaacattcatctcacacaattttat

SEQ ID NO: 404090 - DNA, 438 bp, Homo sapiens
attttatcatattaaaaagctctgtgcagcaaagggaacaatgaacagagtgaaaatacaatatcaaaaagggaagaaaatatttgcaagctatccaacaggggattaatatccaggttatataaggtgctcaagcaactcaacagcaaaaaaattaataaataaataatccaactgaaagatgggcaaacgatctgaacaggtgtctcacaaaacacacacacacacacacacacacatcaacatcactaatcatcagggaaatgtaaatcaaaaccactgtggagtatcatctccagatagaatggctattatcaaaaatagaaatattagcaaatgctggtggggatatggagaaggggaactcttctacactcatatatggaagctaaaaatagtgattttacagtggtaaacagtagaatagaggatactaga

SEQ ID NO: 404091 - DNA, 206 bp, Homo sapiens
aaagcaccaagcaatttgcttttgctggtgaaggaggtataaaaggtagagttgcaaaggctggggatggagctttaggctgggatcagcgcccaatgggctgggatgacaagtgcttggggcacattggcagctgcgaaaagctcgctctgatgcctgtgtggggacagatttgggggcaagaggactctccagcaatctgtgat

SEQ ID NO: 404092 - DNA, 366 bp, Homo sapiens
gaaaatgacttgggaagaggcagggcgctcaggggtttttgtccttccagctatcaagtgataacctctgcttttaaatttccatagtgtgcagccctgtgtaggtctcctgcgtggctctctggtgtgagtgtgtgcgcgcgtgcaaacgctgcgagcgaattttaaagggcattccgaggatttcatttttcagcggagggtatttgtgactcagcactgagggctgcagactcgagggctggtggctctgcccactttatgcttgcacacacgtgcttgccggggcaccctgagcccaacggcacgaagtcaactaacacagtcccaattgggtggactcttgagttttttccttacttaaaa

SEQ ID NO: 404093 - DNA, 980 bp, Homo sapiens
gataaattcacctttagttttgaggcacagcaacccttattatattatagctcttacttatattcacagttctccaaggaaaaatcaaagctaattcttaaagaaaaatgtttagcagtcctttgaataaattttaagaaaataataggtaaaaccgatctctggacatagtttatgtgagttttcagaggtctttgcaagtgtcttagtaaaagtttaaagaaaataaccatagtgtaagtaggaaagtcttgacatgaggttgtcagcttggccataggaaataatcaatttactgcctttcagaattcactgtttatttggctttttgctgttcttgtgtgtcgaattccttggtgggctgaagcactttcttaatgtttggagaaaatggcagaaaatagtcttttgaacaaattccatctagtagcagtttggtggggatgagtaggtgaggtaagatgttagagggctgggtaatagttgtgaataaaccatcaaaggactttacataccccacctttcaccccagattggtttggcttaaagctgacaatgacagcaggatcttgaattagaaggtccaaagctcatagggtggtttattttcactgtttattcatataagtgatgttattgggtgactccaaacacatggttctcctacagatgatatcacctaaatgccaaacactgtaaagtattcacaggtacaaaatctttttattctagtaagtgataagttaaagagaaaattacattgcactgaagacgtatgatggtagagggaaataaaaagtactactaaagtgcataggagttgcacctaggctagacctggggtaagtttgtgtttgtaggcactggggacacttgatatcctagctgaatccaaaagaacttagatgatgtggcaataaggataggatcagtggagttcagtgaagagagaatgctatgtgcaattaattgtctgtatc

SEQ ID NO: 404094 - DNA, 436 bp, Homo sapiens
attgatttaattgacatttacagaatatttctcctacaacagtgggatatataatatattctgttcaagtatacatggaacgttaatcaaggcagaccatatccagggtcataaaattctttcaatatcaaagaactgaaatcctacaacatatattttctaactataataaaattaaactagaaatcagtagtaaaggtaacaagaaaatcttagaaattaaattacatacttctaaataatccatagttcaaaggaagtctcaaggaaaatttaaaaatattctaaacaaaaataagaatatagcatatcaaaatctgtgtgatacagctaaagtagtccttagagtgaaacttacagcatgaaatgctcatattaaaatagaacaatgatctcaaatctacaagttaagcttccaccacaagaaacaagaaaa

SEQ ID NO: 404095 - DNA, 434 bp, Homo sapiens
gtgactctatcatggagcaactgtaaggacccattgagataatgttcatgtagtgctaaaatggagcatcacgcacatggaaatcctttaccatacatgttagtatgattgttgcccttgcaattcatataaggttaattggtaatcagcagtacatgagttttgaagttgtaatcaggttgtacttccttaaaatcagttgtatgattccttaaaagccaagaatgaatcatgatcggttaacatttctgttatctttctgtgtgtctaaattctttataatatttacctcacaagtgtcccagcaaagtgggattggtttagctttgctcactgagaggatgagacaaaaacatttcttaaatttagaataggatgattttatgatgttttacccaaatgatcaatccaagtaaacaaaccaatttcttatg

SEQ ID NO: 404096 - DNA, 516 bp, Homo sapiens
ctgctgtttttaaaccatggagcagctgggttctctatggaccacggagcattagtgagagattggcttccaatgtgttagcacgaggtaatgtaaacaaacagtccaagttttaattcctcttttatgttgttttgcactatccttaagggcaagagagggcaaggtggaggggctaagtttgacttcatgtggctcaagaatcagtccctctacttgttctcaaggttgctagaaactggttgcttagattttctctttctttcttagcatgataaagtatcaaacaatatttttttgtgaatttttaaaaccgatacataatgcttgtggatatttctgggatgcatgtgatattttgatacatgcatacaatgtgtgatgatcagcaccacctcaaacacttatcatttttttgggaacattccaaatctttcttctagctattttgaaatatataattatgggtttttttttttaggcctaaggaattccacagaaaaagataatgggaaa

SEQ ID NO: 404097 - DNA, 91 bp, Homo sapiens
ctgggctggaggaaacctgcctctccagggacatgggaaaagaactcatcatgggaaaaagaaccatcttctgcctcaaagacagcatggt

SEQ ID NO: 404098 - DNA, 360 bp, Homo sapiens
agagtgggtagttgagtaggatgagacttctttggaggcgaggctaactacattaaactctgggaagggagggcttccgtcggaccctgggagaaaggcaggtctggagaggaaagactggcttggggggcctgcgcgtccggctctggaaggcaactcctactgggggcggcgcgcagccggcctggcgggcgagcctcgtgcggcccgggggtgcggccggcccgcgcgagctcaacaggagctcacctgggatgcgtgcggccctgtgggaggaaacttcctgggtaggtgaaagctgccccgcgggagccggcccggcaccggcagagcgcgaacgggtcacagtccactcggcag

SEQ ID NO: 404099 - DNA, 368 bp, Homo sapiens
gacccccccatcgttgctcctaagatccttaggacccacctggaggactgtgggtgttaggtgtccaagtagaaagttcaaatcttccgaccttacgtgggatttacgatccgacgggtccgaacgcagctcgggaacagaaagaaagcaggttatttgcaatctaccggagcttaagggcagaaggcaggtgagagaattcttaggagctgtggggttttgtaggctgtggatcccaaactgcagtattagccaagcctttgtatgaggtcacaaatggggcggggacccggaacttttgaaatggggatcccaacaacagcaagtttttcatgagttacaagaaaatcttctggcagcccacccga

SEQ ID NO: 404100 - DNA, 497 bp, Homo sapiens
catataatggaatactatacaaccttaaaaataaaggaaaacctgttacaacctacagcatgaaagaaccctgagaatattatgctaagtgaaataagctattcacaaaaggacagatgcagcatttttctatttatataaggtatctaatgatcatagatatacaaagtagaatggtggtcaccaggggccgggagaagggagaaaggggagtttcagttctgcaaggtgagaatgttttgaagatctgtttcataacaatgttaatatacttacattactgaactgtacacttaaaatggttgatagtaaattttatttttttaaccacaattaaaaaaaaaaacccaaatggacattgtaaaagtggaaaatacctaaaattaagaaatcaccagagggactagcaggagactcaggtatagcagaagggatcagtgacaaagacaggttgataaaatataccctaaatgaagcaaagagttaaaaaaaaaaga

SEQ ID NO: 404101 - DNA, 418 bp, Homo sapiens
ctcgctcaaggtcaggagctcaagttcagcctgggcaacatagcaagaccccatttctaaacaaataaacaaaaaaccaggcatccaaggacttcatatgggcttcgtgactgtagtctggagtggtatctgatttacagtatatagtgcatatctttttatgagagtttggagaattttccagtctgaagctagaagtatagtggcagagttgaattttcttcttgaggaaaaggataggtagaacagttaaaagtattttgtaggatgatgttttggattatatattgtaactgattttattacaagagcataactaaacagaacactaatagcagaagaaaaaagtatggtagcttaagttgaatggaaaaaagtagaacctgtttgaaatttctggatggtgttttggtcaaaa

SEQ ID NO: 404102 - DNA, 514 bp, Homo sapiens
  misc_feature (183)..(183): n is a, c, g, or t
  misc_feature (245)..(245): n is a, c, g, or t
cagagaattttagatccagcaaaactatccttcaaaactataagaaaggatgagcatggtggctcacgcctgtaatcccagtactttgggaggctgaggcaggaggattgcctgagcccgggagtttgagaccagcctgggcaacatggcaaaaagccatctctacaaaaaatacaacaaacngctgggtgtggtggcatgtgcctgtggtcccagctactcgggaggctgaggcaggaggatcncttgagtctggcaggttgaggccttgattgtgtcactgcactcctacttgggtgacacagtgagacaccctcaaaaaaaaaaaaaagtggaaattaaaacatacccagataaaaactaagagaattcactgctagcagacctgccttaaaagaaatgctaaaagacatccttcagactgaaatgaaaggacactagacaataactccaatccacatgaggaaataaaaaacatcattaaaggtaactacataggtaaatatgaaatata

SEQ ID NO: 404103 - DNA, 404 bp, Homo sapiens
ggtttatggtggtgatttaaggccaagagacagactccaggctcatctagtaacactcaggctactccagttcaaaggcagccacgtgacagttcctgaacatatggttgttgaataaatgaatgaaaaatgagaaaaccaggagctctgatacttaaccacaatgatgctgctgaatttgaattgggatcgtatgtagttcctcatctaggaactagtgatgagtcaaatataaattaagatatagtttggaaatattaagaaatatgtattgattttaaccagaaatatatgatctgaaagacagtagaatgtaattattggtctgtttacctgacattttgcttcccattatgtatatgacgtgaaaatctttattaaaggaaagtatttttgtatcatgc

SEQ ID NO: 404104 - DNA, 676 bp, Homo sapiens
tgtcttccatgtacacatacatgcacatatgcatgcacacacacacacacacacacacacatactcttacataactgaaatgacgatatgcttctggtaaatactacataattattttgtaagttaatatttattattctttaacagctcatggtaaatgaccatatcatatggcattccattgatgtgccataatctatttaactctctgttgtttcatctttatgttgcttccagttttccacttttactaataacacatttttacagaaatatttattcaactttctaaatagattctttgaataaatcctaaaagggaaaacaatgggttcaaggggttcttggtacatgttgctaaattatttttcataaagattctaacaatttttaccctggaagcagtaagtattactatcatttttaaaaatacatgttactttggtgtttatcaatgatattggtgataaattggtattaccttgatggctagtgagctttgacacaatcccacatgtatgctcacatatacttattcttctataaatgttttgttcatgttcatttctcagtttttggaaatttgctctttcatgtttgtcttttctctatttattgacatttatctttcccacggctttaaggtggaaaaagaaacatgacatgtccgttatgt

SEQ ID NO: 404105 - DNA, 455 bp, Homo sapiens
ggtcataagtgtaacagataaatacattagggaaatggaaaacattcagcaaccacaaggctggcaggttgagagggctgggggctgctgattcaagagctcttcctcctgctagtttatcatccacacttcagagatctttatggaaatgaccaataagccagactagtgcaaataagtccactgaggtagttcttaatacccattcttatcaaattgaatcacgatggaactaatcttctacaaattatttcagagagttgacattttatgtgcacattaaacctacctggaaaggggccatcaaactggagaggagcacagctgatttctgtcaggcttcaacttggtatttattaagctaagtctgtatatcctttagcactgagtgaaacatgaccatccttaacttacccaaggtagaggcagcaggagaaaacaaagcagctaggaaa

SEQ ID NO: 404106 - DNA, 362 bp, Homo sapiens
atgtatagttatgattaaatacggaaatctctcctattttttcaaccgatcagacaatgaggcagtttaggaattgagtgtggtatgatttgattactagtaaattgatgttgaaaacgtaaataatctttgctaaattgatgggaacaaggacgtatttttattttattagttatcctggtaatgagatataatgggaacatttaaacttattgccattcttctaaagaaatgttttttgtttggaaatattgagtattctgatacatggagaattataaagggaagctgaaagagttactgacattttcctggaagtagctgtgtaagagtacagaaaagtctttttgcattaaatccaa

SEQ ID NO: 404107 - DNA, 247 bp, Homo sapiens
atggggccttttggaggggatggagtcaggagggcgagtgggattgtgggattagcgctgccatgaaagggcttgagggagcctgttagtcccgcttgcctgtccgccatgtgaggatgcagtaacaaagtgccatccttaaagccgagaccaacccctcatcagacactgactctgctggcaccttgatcttggccttcccagaccccgaaactgtaagcaataaattcctgttgcttataaatta

SEQ ID NO: 404108 - DNA, 276 bp, Homo sapiens
ctcgtttgactgtcaaagtgtaccgtttgcattcccaccagcaattaatgagttcctgttgctccacaccctcaccagcatttggtggtgtaagcgttctgggttttggctatgctaatggttatgtggtggtacctgattgattgacatttgcagtcccctcatgacatatgttgaacatcttttcatatgcttgcttcttggtaagttgtcttttcaggtcttttgcctgttgtttaattgggtatttctgattattgaattttaagtgttgtc

SEQ ID NO: 404109 - DNA, 336 bp, Homo sapiens
aatatttcataactaggtatgccttatgtctttttgtgaacaacggcttttctgttcttaatactgttgtccatttattaaaaatatatatttaatatttattacatgcaaatgttatctgtaggtaagactatgaagatgttctgtagcttaatttgaatgaattgtatattcaaacatgtttagtatgactagttacaagatgactaataatttaaaaatgcctgtgtgggtcaaaggaatcatctatgctaatgtatttgagccaaattatattatgttaatgacatagtgtgttattttacttagaattaaacaaacatataatgaaagata

SEQ ID NO: 404110 - DNA, 711 bp, Homo sapiens
taggtggaaagcacgtgagtgtgttcatggagtagtgtacaaggccccaggtgggatgacgtgagaaggccccaggtgggatgacgtgagtgtgttcatggagtagtgtacaaggccccaggtgggatgaattgagcatgttcagggagcagagagaatgctgctctgtccagtacctgtgagcaggggaggtgggggcgggaggaagtgagaggtaggatctggtaccatctcgagaggctgcagcagggacacttgaagatctagtgacacctaagagctccctgttgctgctgctgggggagcaggaagggggatcaccctgacaagactggtggcagctgggacaagagtcgtggctgaggaggagggaaggaggtcagcttcccgatgtgtctgtgggccggcaggactcaccgccgcaggcagcaggctcaggcacctttggtaactaggcccacaacagatcctgaactccctgtacgtcgcatgcacatctacagactaaataccaaggagttttctaaaaaggccaatgacaggtcaggtggacctgaattgttaccactaattaggataaaagaggtttacagatgccttgggccagggcagtttcccggaaagtctgaaaccagctctcaggtgtgttttgtggaagacacggctcctctggcacagggctgtgaaactagctctcagacatcggtgaaa

SEQ ID NO: 404111 - DNA, 417 bp, Homo sapiens
cgagggtctatgatgtgcctacagtttggtgagggtctatgattttcctgtgctttgtccacacccttcatcttcagaaccacgtgaggtcggaattgatagtctcactttgcaaatgagaaaacgttggctcagagagttgcacatggcaagactcagcttcaacctgagtgtttcccaagctcagacatgaaccttcccctacacaaatgggccttatgggaagagaagagttatttaattctgggagaaatgcatatcccaggaaagtacagttgacccttgaacagcatgtgtttgaactgtgcaggtccattttatatgctgatttctttcaataaacatattagaaacatttttggagatttgtgacaatgttttaaaacttgcaaatgaaccatgtagcctagaaatatc

SEQ ID NO: 404112 - DNA, 623 bp, Homo sapiens
acttttcaggggaagagagattccagcaaagatcctgggatggagaaggtaacattttgagagaaaggtgagtaagaagttggcagaagcccagggggtcctgttgaagagtcagagttggacgccttctagctcagcttggttgccagcgcagggaacagagggctgtagctctttgcatcttatactcaaggctgtctgcaaagtgattcagaatggtttgagcccctgatcatttcaatgcggggtagctagggcatatgcctacgggagccaggaaattacccaagtgctggaatggccggggggctaattggagaggaccctgtgtttcccactctcctccctcagtattgccagaaggtcagatttttttctgagaagccagaaatgtgaatttttattgaaagttcccaacttctacaagtttttttaaatactaattacagaaataaaacttagaaccttttgggggccaattttgggggtgatggacatgtcctggagttagatagtggtaatagttgcacaacattgtgaatatagtaaaaaccactgaattgtagatttttaaaatgcttacagtggtgaattttatgtgatatgaattttatcttaattag

SEQ ID NO: 404113 - DNA, 449 bp, Homo sapiens
  misc_feature (13)..(13): n is a, c, g, or t
  misc_feature (53)..(53): n is a, c, g, or t
agaagagaggggnaaagagaggaagtaaattaaaaatataaatagtttagctncgtgcaccgaactaacctggaaaacctccattctactctctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcac

SEQ ID NO: 404114 - DNA, 436 bp, Homo sapiens
  misc_feature (38)..(40): n is a, c, g, or t
acttgtcaccacagacaacatccaaaccaccaccgcgnnngtctacgctgaccgacctggaaaacctccattctactctctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcac

SEQ ID NO: 404115 - DNA, 957 bp, Homo sapiens
  misc_feature (38)..(40): n is a, c, g, or t
acttgtcaccacagacaacatccaaaccaccaccgcgnnngtctacgctgaccgacctggaaaacctccattctactctctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcacattcctcatgttgcattaaaattattgctttgattgttttttaattcgactgcaagctccactccttgtacctggcttctctcactgaacttgacccacaatagagcaaaacaaaacaaacaacctcatgaaacctatgagagtttagatagtgctcaggctggttgtacaaatgaggaaacaaatactcagagaggtggactcacttccataaggttacacagcaagtaagatggtcgaagcttgcattaaaaactgggttttctggagccaaatcctatacgtccagctaattaaggtaaaagaagggaatctgggcctgcaataccacagcactggcagcctctgcacaggtgtcactttgagcctctgcagatctctgcatgagccccttcccctctggccagaaaccgaagcttatctgtggtttcaaagggccaagaactggacagagtttatcataggaatggagaatgttgtctgcttctgtcaaatttcaaaattttgcagttttgtctcat

SEQ ID NO: 404116 - DNA, 530 bp, Homo sapiens
  misc_feature (38)..(40): n is a, c, g, or t
acttgtcaccacagacaacatccaaaccaccaccgcgnnngtctacgctgaccgacctggaaaacctccattctactctctgcttctatgagtctattaacagatgaatggatatagaaaatacggtgtacatatgcaatggaatattattcaggcataaaaaaagaaggaaaccctgccatttgcagcaagatggatgaacctgcaggacattgtgctaagtgaaataagccaaacactgaagcttctctagattgatgttcctcccactgtgtttccctgacctgactcctcaccttccatcctcagatgaagcaccacttcacataagctttgcctgattcgtcgtttctgcctacaccacatatttccctcaggctttactgaacactacgcacatatgcatttattaaatcacttttaacacttttctcacattcctcatgttgcattaaaattattgctttgattgtttttcctcaacaaaaacaaaaaaatggccttcgttggcctcacagggggacccctgc

SEQ ID NO: 404117 - DNA, 423 bp, Homo sapiens
tctgtcttcccatcaagtctgatcatagagacaacagagaagctactgaaataaagccattcaaagtgttttcaccctttgctgaggaaatgtggaaccaaatatacagaaggaggccttgagcccccacatagacaactgccatgttataataataacaagtcttagcttctctttccactggctcagcaggatggatcaaagccacccgccatggccactgcaggtagaatagatggtcacctatgggggatgacctcaagagctccaggtgtctgccgtgaggcatgacagtgcctcagattcctcacttagaatcctcatgtttgcaatcccaccacttttagaagctgaggtgagaggatcacttgaggctaggcattcaagactagcctgggcaacacagtgagactttatctctac

SEQ ID NO: 404118 - DNA, 841 bp, Homo sapiens
aaataattctttaaagctggaagacgcaagtttctatcattctctacgaagttctaacctagatcttgagagaagctggaagacggggatgatttttctagaaggatcccctgcccccagtccctacccccgcttctgattcagaagctcctctggggcctccctggcaccctgcatgtgtctacaattcaaccccgaccacactttgctgcaatgtcactggttcacactcgggatccccaagagactatgagcttcttgaaggcagagctatgtcccattcatttctgcaccccaagcacccagaaaaggccatggcagggaatttgacccaaaaaagcactttgatgactgagcaatgaagtgactgggtgggcagagcttaggctgaaggaggcgggctgagctgcacctggggtggagagagcctgagtccactcctagttaaggtctgtcaaacccatctgcaccgctcatctgccgcaggggaggctgtgagggggcagaagcagctcctctccctgagggctagccatctggagggagacctacagacctaatgtttatgctgcatgctggaatagaaggaatcgtgtggtgctgagggaacctgtcccctaacccagaccagaggaggtccttccataagagttccctagagaaggtggcaccagagccaattcattcattcattcactcgagagatatttactaagcactcactgagtgccagcactattgtcagtcctggggatccaagagtgaaccaaataaagagggccagtgccttcgtgaaggttacatcctagtgtaagaaacaagtaataaacaagtgtgaaac

SEQ ID NO: 404119 - DNA, 731 bp, Homo sapiens
cttgctcacatatgtaacatttggctggctgttagctgaggtaacagggctgcctggactgcctgtctctcatcatctatgaggctagcctgttcttgttcacatggtggatttgcagggttccaggaagacagtgggaatgtcgaagagcttgccaccttctactggccccagcatgtaactggcaaggccagacttaaggggtagagacatagattctacttttgaaggaaagggtctcaaaattacattacaagagtgtggatacaggcagggaaagaatttgtgaccacttttccaaagtaccacacttggaaattttaaattatgaatggaccgagttaaccaacaaggcttttttatttgtccattggttttttgccctaatgaaaaaaggttttgccttgctttttgactgagtaataataatgacattcttggatttcactggatccccacaacccactatgtgagaatattattgtttccacagttttaaaggtgaagaaattgacattctggcagattaataataaccagcacatagtatacagtcaacactgacgttggagcatctagaaggttaggcatattgatgccttattgaataaatgaataaatagtaggtggcagttttgaaattcaaacttaggtttgccaattccggaggtgattctgggatgcttcgttttattcattaatgctcaaatggatgctctggtagattttta

SEQ ID NO: 404120 - DNA, 537 bp, Homo sapiens
atgccaggccatggacagaacaagcccagtgggcccaagtaaaactcaggcaaaggcgccatcagccacagacgtttctggctggaaaagtgacaccccaaagatctcataacaccaggcccaactgtccagactaaaaattataaaggagtcactcatgctcaccaaaccgaaattgagctgtcaagaaatcgagagaatgaatttcccaaagaggccagtttcaactgacgtcgtatgaagctctctctgttttaatctttcatctgaagtaacctgatgttaaccaatcagcttatttttccattattctatctccctgtccccaccctaaaatgaccaatccactttttttctggagcaaccctattaactgagaccaatccactttttgttctttttttcttctttatccaaccccttttctgtctataaagccaatctcctctgcttcactcattagaacacttattctattttatagaaggaagtgttgcccaatgctagaatcacaataaacccaattgagatctttaa

SEQ ID NO: 404121 - DNA, 580 bp, Homo sapiens
acccctctggttctggaagaaattccaagtgaggcactgtgctagatcctgaccatgggttccagtggaaggtagaatctgtgtgggctcaggagcctgggatgggaggcttccccaactgatggattcagaggactctgacacatctgtggcagccagttctttttctaccctgttgaagatactcatatgtgagggcagtgtgtgccttctatgggactgctttgatcactgccaagatgtcacagaagtctttaattctacaaatgattggtttcaggttcttagacaaacaagctacattttgcttctggatggcagctctctgtgtggaacaatgaatgagggttcaaagtagtcttcccttcagatacctgagtctgcatggactaagacgtagccataaatctaagagcccacgaattcacatttcactgcctcatgactagtgctgatatgggaacagctggatcaaggctttctctcctgaaaacaaatttgccagccaatcagtagtgtgaaaaatatttcaagaaaatactctatctacccaagagaacaaattgtgtgcacagatctt

SEQ ID NO: 404122 - DNA, 262 bp, Homo sapiens
gctgacagaagccagattacttgcagcctaagggccacagtaaggagtttctattttcatttaaggggattgggaaactattagaagggagtttttaaaagcaagacagcgacatgatctgattaatttttttagaaagctcactttggtttctgggaggaaaacagagggtcaggacagaatcaggaaggaaagttaggagacaatccatttgtccagatgagaaatggtgacatgaatgtggtggtggtggtggtagtga

SEQ ID NO: 404123 - DNA, 626 bp, Homo sapiens
gcaaattacagcctctttggcttctgaggatactagtctttctccccttaactcagggaaactgctggactcagttttgattcttcctcctgtgctacagccctgggcaacagagcaagaccctccctcaaaaaaacaaacaaaaaataagtaaaaaatacaaaaaaattaaaaatgttctgttttcatacgcacatgtctgcctcactcatagttttatttttataaattcaagcacacagtagagactctctttctgactttatttgcagctacttttagaaaaaagaatctgactggctcagcacagccaatggttttgcttccctagtgccaagtgttcattcctgatccaagtagctgtggtcaagggagcaggatcacaggggatgagcatgtctccagggccacactgctgggtccaagtgggggaagttttcagaagagaggggtgtagattggacagtatcataaaatgaatgtagtacagagggaagccagaagtgaaagtaagagagagggtgtttctagaaaagaaaagtagttaacattgttattctgctaagagaacaagcaagataagtactgaaatttatagaagacttagaaaataaattaaaaaaaga

SEQ ID NO: 404124 - DNA, 571 bp, Homo sapiens
ggtggttgaggctgcagtgaactgtaacggtgccattgtactccagcctgggcaacagagcaagaccctccctcaaaaaaacaaacaaaaaataagtaaaaaatacaaaaaaattaaaaatgttctgttttcatacgcacatgtctgcctcactcatagttttatttttataaattcaagcacacagtagagactctctttctgactttatttgcagctacttttagaaaaaagaatctgactggctcagcacagccaatggttttgcttccctagtgccaagtgttcattcctgatccaagtagctgtggtcaagggagcaggatcacaggggatgagcatgtctccagggccacactgctgggtccaagtgggggaagttttcagaagagaggggtgtagattggacagtatcataaaatgaatgtagtacagagggaagccagaagtgaaagtaagagagagggtgtttctagaaaagaaaagtagttaacattgttattctgctaagagaacaagcaagataagtactgaaatttatagaagacttagaaaataaattaaaaaaaga

SEQ ID NO: 404125 - DNA, 817 bp, Homo sapiens
aaatagcaaataatgaaagtgggtcagatttggggaaagtggcaacggcatggagatgacttcagttttaggtatttcgagtttgaagtgtctataagtcatctggagctgtccaggagatggttctatacatgaagatcaggaccagtttcttgtcatcagcatataggtgcaaaatgagtacacacagaagaagagagggtctgctgggcacagtggtgcaggtctgtaatcccagaactttgggaggctgagaatggtggattgcttgagcccaggagctcgaaaccagcctgggcaacagagcaagaccctccctcaaaaaaacaaacaaaaaataagtaaaaaatacaaaaaaattaaaaatgttctgttttcatacgcacatgtctgcctcactcatagttttatttttataaattcaagcacacagtagagactctctttctgactttatttgcagctacttttagaaaaaagaatctgactggctcagcacagccaatggttttgcttccctagtgccaagtgttcattcctgatccaagtagctgtggtcaagggagcaggatcacaggggatgagcatgtctccagggccacactgctgggtccaagtgggggaagttttcagaagagaggggtgtagattggacagtatcataaaatgaatgtagtacagagggaagccagaagtgaaagtaagagagagggtgtttctagaaaagaaaagtagttaacattgttattctgctaagagaacaagcaagataagtactgaaatttatagaagacttagaaaataaattaaaaaaaga

SEQ ID NO: 404126 - DNA, 327 bp, Homo sapiens
aaatagcaaataatgaaagtgggtcagatttggggaaagtggcaacggcatggagatgacttcagttttaggtatttcgagtttgaagtgtctataagtcatctggagctgtccaggagatggttctatacatgaagatcaggaccagtttcttgtcatcagcatataggtgcaaaatgagtacacacagaagaagagagggtctgctgggcacagtggtgcaggtctgtaatcccagaactttgggaggctgagaatggtggattgcttgagcccaggagctcgaaaccagcttgggcaacatggtgaaatgccattttttttttt

SEQ ID NO: 404127 - DNA, 1139 bp, Homo sapiens
gaatcaaagaatattaatacagagaagtcaacaaaactcaaaggaaggcaagcagagaggaaaagagggaaaaaataactacaagacagacagaaaaataataaaatggcagtagtaagtccttccctatcaataattacttcaaatataaatggattaaacttaccaatcaaaagacatagagggctgaacatattaaattttaaaaagcccagattcaactatatgctgtctcaagagtctcactttagatttaagtacatacataaactgaaggtgaagagatgaaaaaagatattccaagcaaatggcagccaaaagagagtatgggtaactatatcagacaaaatagactttaagtcaaaaactgtcataagagacaaagaaggacattatataataaaaggatcaactcaccaagaaaatacgatatctacacacccaacattagagaacctaaatatataaagcaaacactgacagaactgaagggggaaatagaagacatagacagcaataaaataataagagactgtagtatttcatgttcaataatggataggacatttagacagaaaatcaataaggaaacagcaggcttgaatggcactagagagtaaatggacctaacacagaacattctgcccaactgcagtagaatatacatctttcttaaatgcacatagaacattcttcaggatagaccacacattaggtcacaaaacaaagagtaacaaatttaagattattgaaatcatactaattatctttttcctaccataatggaataaaactagaaatgtatagcagaaggaaaacggaaatattcacaaatatgtgagaattaaacaacagactcctgaacaacaaataggtcaatgaagaaataaagaaaattagacttgagacaaatgaaaacaaaagcacataccaaaatctttgggatgtagaaaaagcagtactcctaagagggcattttatagtgataaacacttatactaaaaaagaaaataaatttcagataaacctaactttttacacttcaatgaactagaaaaagaacaacttaagcccaaagttccttcccaagagaaaggaaataataaaaattagagcaaaaagttgtttaaaatagaaaa

SEQ ID NO: 404128 - DNA, 355 bp, Homo sapiens
aaagaaaacatcctaactccttagcatttaggccttccaaattgggatcttaattttttaaaaaataattttaattctttttagagtagattttatagtcacatggctcaaaaaagcacctaggtatatggtgaaaagtcttcctttccatttttatttcagttcccctatttgtttcctgtgtgcccttccaggagggcttctaaatatgtctttttaatgtttcccgcaccacctgcacagttttcccatcggatcatcctgtctttgaatgtgcctttgctgttcttctttctgcctgtaaaatactccttctacccggctatgaatctattaaaccaagaaatatccaaga

SEQ ID NO: 404129 - DNA, 337 bp, Homo sapiens
aaaatatttaattttcccgatgtttttaagagctatccgctgagagatttgtaccctgtgaagagagcaggttcaagagatgacagattagaccatcttctctaagaagaaatgatgtcatggttgtttagggagttaagcctatttgtgtgcataccccacctataattagcattctctgagggatgggcataagcattgctgggataggattacccctgctgttccacagtatcactgctattgtgaggctggttacataattctgtcaaatgtcctgaggcacaagggcacaaagagcattggccctaccagaaggctcatttttcgtcacaca

SEQ ID NO: 404130 - DNA, 806 bp, Homo sapiens
tttagataaaactagactccgttcagacagtcacaggcctcaggagccccatcctgtgctggggggaaggggtgctgataaaggagacgccttgctctgcagaacaaaaataattccaccactgccaccgctcacagcatctacagcaggccctgtgctgctgtcacaacctcaccctggtcccctgaggcggatatcaccatcccatttcagagacaaggaaaatgaggcccaggtgcgtgaagaaactggcctatcaaggcagagctagcgggtagcatgctggacttctaagccttcctgagaaagtgaactgcttcctctgagatgggcataggcatggctgtgtgtgcatcttgtcctgaccattccacagtggctgttatcacactccatttacaagttggctcagaaaaccggaggtgaagctgaagcagcccagctggccctaagaagccctggacgctccctcccatcctcacatcgttgagtcaatgctattatttgaatgtctgtgtcccctccaaaattcatgttggaacttaatccttaaggagcagttttaagagatggggcctttaggtcatgagggctctgctctatgaatggattagtgtcttataaaagggcttgagggggccagttcccccctcttcagtcccatatgccatgtgaagacacagttcatggtgccatcttggaagcagagagcaacccttaacagacactgaacaagcccgtgccttgatcttggacttcacagcgtccagaacagtgagaaataaatttctgttgtttacaaatta

SEQ ID NO: 404131 - DNA, 603 bp, Homo sapiens
agagttgaatgtggcaggtgctttctgcacttcattgaacacaccaggagaagacatatctggttgggtggtctcatgctcacaaacctgcatcagggcttcggcagctgccctggggctgaggtctggttctgcaggggcacctgaaaagccattggcattcttacacaggagagctggtcgatgccgaggtgaggcagcctgtggctctcctagatcgtcttcttttccggaagctgcaatcagggaagttttagctgatctcagagggtcaggtacagtccccatggaatttctcttcaggagcactccagagctctcttgagtactggtcccactggtgggggaggggagcgcagtcagagctcagagtgatgacacagtcagggatgattcctctgaagaaccagcctgtgaatcaaggaaacagcatcattaatacagtacgtcgcttaaggattgaaaaataaaccaaactgtcgtttttataagagcacattaaaagcttttcttcccatacctgttgatacaaaaatagaccttgtggggagggagaagaaaaataaataaataaaaatagacttgagaaaaagattttgaaaa

SEQ ID NO: 404132 - DNA, 235 bp, Homo sapiens
gaccagggtgttagctgtggtatttgctgaaaagtgggcaggttccagatattgtggcatgaatgtacctgtttctgccccttacagccacagtgcgtgagtgcttcaccattactgtggtgaagctctggggaaacaggcacatttatatgttactaatgggaatgcaaactgatacaactctttggaagggaatttggcagtatctaacaaaacttcatatgcacttacgatc

SEQ ID NO: 404133 - DNA, 350 bp, Homo sapiens
ttctggcgctgtactaaactcaattataattcctctctcttgagacagaggtctccaggctgagttcactgtttctgatacctcctattagcttgttcccgatacctcctattagcttgttccctctcactttacaagggcttaattagccattataggagactctttccaaatgcaggctttgcaaaatgattagtgctatgggccgtacttcaaaaataaaattgcatttaggataattttctcatattttaaaatgttactttcatgataaaaaataatacaggaaaacattcttattgcttcaaaaaatccaaactgtactacacagtgaaattactgcttgactc

SEQ ID NO: 404134 - DNA, 343 bp, Homo sapiens
tactacaattactttactattaactgcctaagtggttattaaatggctaagtctggctttaaagcatcagagttctaaaggtttgtggaatgactcaccagctgtgtattttaactgggatatggttttaatttcaagcatatatacccataacacaacattcctctctagcagatcaccctctcctacaaaattttaatgactttttgcccaggtacaacactgctgccttctacctgtgaaatgcccccaagccttgctggagccagaccaccgcccctgctcacatcctgtgcacagccacccttggctccctcttggtgctcaatgtatgtgatgaaga

SEQ ID NO: 404135 - DNA, 539 bp, Homo sapiens
acctctagatgcaaagtgtcaggaaggcttgtgggttcagtctttctgtgctaacaccaggccacatccaggcctgatgtactaactgatctccagttcattccttttgcaatttttggccttgattcatagttcctgattcttgattggctctgaaatcctccccattttcaaaagggatgcagtcaagcaggccaaagcgctccatgttagctaacaaatgtttgcaaatcataataatgtaggaagagaaccataaactaaatgaacaacaggcattagccctcatgctgtcacataagcattcctcaaaatataatcatgcttctaaacatgggctggcaattcaggaaagggccactgaaaatattagcctcgttcttttctctgtagagtgagcacagactattcctaaaccacattgcagtatgccaacattgtaaattaatgcctgattggttacctaaaagtaagacaatcttacttttaggcatctagaacactgagaaatccaggatggacacttaacattaccaaag

SEQ ID NO: 404136 - DNA, 322 bp, Homo sapiens
tcacactggcccatcagcatctggacttttatgtccagaagcactaagattctggacatttatgctggccctttggaatcccagtacattactgatctaggaaaaggcagaaaagatctatgtgtaggtcagttggagagcaaaagtagctgggcatggtggctcatgctcgaaatctcaacacttcaagtgatcctcccaccacggcctcccaaagtgctggcattacagggatgaatcaccacacccggctgctaatttttaatttttttgtagagaggggggtcttgctgtgttccccaggctagtctcaaactcctgg

SEQ ID NO: 404137 - DNA, 882 bp, Homo sapiens
actaatatcttacaagcacagccaaccaaagcaaaaatggacaaatgcaatcacatcaagttaaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcatgctgggattacaggtgtaagccaccgtgcccagcctacacccttaaaagttattgaggaccccaaataacttgctcattgtggattgtatctatccatatttattgtattagaaattaagactgagaaaaagttataaaacacaagaatacagatgcacacgttccattagccatcaaggtgatctttctcccatgccagtagtctctggaaaattcctgagaggatgaaaataaaaaaatcacccatacaaaaaaaaaaagtgtcaatattattatgaaaatagttttgaccttgaggaccccctgaaaggtctcagggaccctcgggggccctggaatcttgctttgagaacagctgatctgggctaatgagcccttttccagcccctctgtgtgagacctcccagaaaccactaagggccttggaagagcttggcaaagaaagaggtgacaggatgattgaggagagccaccctagggaaagccttcagagaaggctttggggacagccccggtcagtggaggaagtcccagagaggcagtcggaagggctagggaccagctgaggcctgtgacctgaaaatcctttccaaagaggacgcctggaagcctggggaaggcacagtgggtggggtagaagactggggct

SEQ ID NO: 404138 - DNA, 720 bp, Homo sapiens
ctcacctctcaccatctgctctgtggctcccagtgctgactctggaagctttatcttgggtaaaagatgtgtgatcagacctttctcgttaatgtatttggctcatgtgacaaatgtttcaaacaacgagctctgagaccagttttcaagaagtctcaacaactcagctactgttcaacatgtgcagaaattatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtgggtaagttggagctacagcagcttttcagaatttgtgttaaccatagaatactgttctcttggcaaaaacaaacaaacaagaactcacagtttttgttgtttaattgtttagcagtatgctaaatccttccctgaacttgatcaaagaagaaaccataagc

SEQ ID NO: 404139 - DNA, 2996 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404140 - DNA, 2830 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaagtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404141 - DNA, 2761 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404142 - DNA, 694 bp, Homo sapiens
aatatcgtttttctttctatgtagaggagcagacgttattattcatgactatcaatcaatctgcatatgtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404143 - DNA, 1404 bp, Homo sapiens
  misc_feature (1375)..(1375): n is a, c, g, or t
  misc_feature (1377)..(1377): n is a, c, g, or t
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaccgtatcggtccaaggttatctaaatatgtgcctcaccatctgccccgggataccgtaaattcccacctctggacagcactcagcctaggcggaatccaggccggacggactccggaggatagacggagccgccgtaaacactccgcagcaactgggtgagccgcgagtgcacggggcaggagggaggtgctcncncggcgacggcaccagacacccgagccc

SEQ ID NO: 404144 - DNA, 1399 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttacactgttcctggtcaacggtttctacatttagtagcccaaatcatcggtcccgtgaatcagagtaattatccaatatcttgaatattctttaagcattagcggaattgagtcgtgagctgactttgggagtggattgagggagggatgggtaaacatcttcaggttgacctttaaagtagaggaatgcggatttgtcggggggagggcggtgttttgg

SEQ ID NO: 404145 - DNA, 306 bp, Homo sapiens
ggaatgtaaggttgagaactgatcctttggctctgctggaacatccagcccctcctgcactcaccccactttttttcatggatagattagggggtcttgattatccagatcctcattctggctttctacttcacactgccctgctggacacagcttttatgaggaattctcagcagtaatctgtaagaacttgacaacccctaaactgtttgctcttctccctccaggatgggaaggtgatcgtgtgggattccttcaccacaaacaaggtgaggcattgttcccagccacgttatagaggcttca

SEQ ID NO: 404146 - DNA, 2786 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404147 - DNA, 1001 bp, Homo sapiens
  misc_feature (961)..(961): n is a, c, g, or t
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggtgaggcattgttcccagccacgttatagaggcttcagaatcccagcctacttaaaggtgctctggtccagctgcccggccctgtcctgatttctctccatgtatccctgcaagcagttgcctctacggatggaaaccccaagaaggcctatccgtgtttgaacagctcagccagcccattgcagcatttattcccctctcgccccaagaggacaattagagccaccataggggctgccaataccaacatggaaatgggcaaagcatggaaaacttgcatccacatgtgcaactgcatgtactatttgtcttctgagtgataagaggcaccaaaattctccattctctctcccctctctttgaccagactccatagccctgtgggaatgaacacgtggagggtggggaagatgaggctgcagtgggactgggcagagctaccctgtgatgcagtctgatccccttgcaagtctggcttgggcatgcacagctcaacttagatttaaattttagctcttaatgaaaataagaccaaaacctatgtgcaggtatgctggaacacntgcattgcattggcatttacaataaagagtattgtgtatt

SEQ ID NO: 404148 - DNA, 2951 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404149 - DNA, 2721 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcatgctgggattacaggtgtaagccaccgtgcccagcctacacccttaaaagttattgaggaccccaaataacttgctcattgtggattgtatctatccatatttattgtattagaaattaagactgagaaaaagttataaaacacaagaatacagatgcacacgttccattagccatcaaggtgatctttctcccatgccagtagtctctggaaaattcctgagaggatgaaaataaaaaaatcacccatacaaaaaaaaaaagtgtcaatattattatgaaaatagttttgaccttgaggaccccctgaaaggtctcagggaccctcgggggccctggaatcttgctttgagaacagctgatctgggctaatgagcccttttccagcccctctgtgtgagacctcccagaaaccactaagggccttggaagagcttggcaaagaaagaggtgacaggatgattgaggagagccaccctagggaaagccttcagagaaggctttggggacagccccggtcagtggaggaagtcccagagaggcagtcggaagggctagggaccagctgaggcctgtgacctgaaaatcctttccaaagaggacgcctggaagcctggggaaggcacagtgggtggggtagaagactggggct

SEQ ID NO: 404150 - DNA, 3081 bp, Homo sapiens
ctcacctctcaccatctgctctgtggctcccagtgctgactctggaagctttatcttgggtaaaagatgtgtgatcagacctttctcgttaatgtatttggctcatgtgacaaatgtttcaaacaacgagctctgagaccagttttcaagaagtctcaacaactcagctactgttcaacatgtgcagaaattatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagatcctgacagcgagcggcgatggcacatgtgccctgtgggacgtggagagcgggcagctgctgcagagcttccacggacatggggctgacgtcctctgcttggacctggccccctcagaaactggaaacaccttcgtgtctgggggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404151 - DNA, 2852 bp, Homo sapiens
ccgcgggtccaagctcgaattccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaaggaccctcaaaggccacgggaacaaagtcctgtgcatggactggtgcaaagataagaggaggatcgtgagctcgtcacaggatgggaaggtgatcgtgtgggattccttcaccacaaacaaggagcacgcggtcaccatgccctgcacgtgggtgatggcatgtgcttatgccccatcgggatgtgccattgcttgtggtggtttggataataagtgttctgtgtaccccttgacgtttgacaaaaatgaaaacatggctgccaaaaagaagtctgttgctatgcacaccaactacctgtcggcctgcagcttcaccaactctgacatgcagggatgtgacaagaaagccatggtgtgggacatgcgctccggccagtgcgtgcaggcctttgaaacacatgaatctgacatcaacagtgtccggtactaccccagtggagatgcctttgcttcagggtcagatgacgctacgtgtcgcctctatgacctgcgggcagatagggaggttgccatctattccaaagaaagcatcatatttggagcatccagcgtggacttctccctcagtggtcgcctgctgtttgctggatacaatgattacactatcaacgtctgggatgttctcaaagggtcccgggtctccatcctgtttggacatgaaaaccgcgttagcactctacgagtttcccccgatgggactgctttctgctctggatcatgggatcataccctcagagtctgggcctaatcatcttctgacagtgcactcatgtatacctgagaatttgaaatcttcacatgtaaatagatattacttctagaggagcttagagtttattgcagtgtagcttaggggagcaacccatggctcacaggtcactaagcgtctccaatatgactattaaaactgtcacctctggaaatacactagtgtgagccttcagcactgcgagaataccttcaagtacagtatttttcttttggaacactttttaaaatgtatctgtttttaaggttattctaaattatagtagcctcaactcattctgtcaccagtagaattcagcagttaatatattccatattatttctttgaatcaattcattttcagagcactttaaagtctgatatttctcgatgtgcactgtgatgcctggaaccttcctctggaagtgctgattttatggactgaggactggtgactggtctgtgatagaagcaaattccaattccaaatgtaattagacaaaaatcatttttttagaatgtgtttttattgtaaaagtatctttttcagcttcctgttctattgtcttttttcagatacaacatttttgtctatggtgaactgctgtaaatgacgcagagaaatgcctaaaaaggacaggtggtttgactcatggatgatgatgatgtcactgtgccacttggacagggcgttttctctgaattgaagggaaagccaatggtgtttgtaaacaaatgcttctgagagcaaagaaaagtcttctgtgtgggaacacaagatagtaaacttatttaaaaacctattagtagaattagtggaaacacttaggttaaagtgaatcttgtccatataaattatattcatggccgggcgcggtggctcacgcttgtaatcccagcactttgggaggccgaggcgggcggatcacgaggtcaggagttcgagaccacggtgaaaccctgtctctactaaaaaatacaaaaaattagccgggcgtggtggcgggcgcctgtagtcccagctactcggagaggctgaggcaggagaatggcgtgaacccgggaggtggagcttgcagtgagccgaggtcgagccactgcagcctgggtgacaaagcgagactccgtctcaaaaaaaaaaaaaaattatattcatatgtattgcattgcaattataattacatatgcagattgattgatagtcatgaataataacgtctgctcctcttacatagaaagaaaaacgatattaaaagaagatcttctctttatttgagactcagaattccttctagaagaaggaagtgctttttgttataggatcccttcttttcctttttttgtttttttgtaagatgtagatgcttattctttgctttagaaaacttctcacttaaaaagatggcatgcacctaggggaataaaaggtcacctcagacaccaggtgtcattcctggtgaggcctgcctcgtcggtggcctggggtctgccggcaggttctggctgcacctgaaggctgcgtgcaccttgtcccctggacaggtctcctttcctggccctgctccagcccagcccttcttctagtggtagctctggctttgcaggcccagctccaggccctgctcctcagagagactcttccagagctggagctgggcacagccataagacaggactggaccagatgctcctgtaaacatccaggggtgtgccaggcccaccctcacaactgcttgttcaggtatcgtgatgggccactcggtccaaaatcagccaggccatcttttccatcatctcacttcaaataaacataataattatatttga

SEQ ID NO: 404152 - DNA, 732 bp, Homo sapiens
aattaaaaacaaacataaaaataaacttattagaaaaatgaaataaaagagaaatgaaataagaataattttattattagatttaacagatcaaatattatttcaatactcagatcaaatgtgcaataagacagggttgcaaaaaatgcacactttttttattaaaatcatttatataagtaatttatataaaaataatattacagttgcaactttctgttgtttctcaactatgaccaaacagaggttacaagtaaagtagcaatcccaatactaaactgctatatgtgcattttgaatcaatcatgtgtatgtcaatgaagtttttaatgtgacagatttgcattttggttgttaatttatataatctaggttggataaatgacaatgccaatcataggggataatgttgatcctaaatgttagtgtgttgatttcataacactcaatggagaagccagtctcagagaggcatggtgctagactggaagacaagaatttgaaataattacagtaagctgatggaattcacttttatctatttttataaagcaagtgattttgtatttttaaaatttatcttcaattcttcatcgatagctacttttaatcattaaccttataaatttaattatatttcaattatattttaatagaaagaatggatttcatgttttttctggtgtggatctttgataagaaaataaaattcaaaatattctgttaaaaaaa

SEQ ID NO: 404153 - DNA, 645 bp, Homo sapiens
cggcagatcgctgttatgaaaaggaggggtggaagtatttaaggaattgtggcaaacaaagtcacagaagaatggatataagcaaaagtagcacactgaaaaaaatggggaaaagtggagtctagatcacaaactggtaagcttggtgatgttctctagccaaattcgaaggtaataacattgtattatggctttctgtttaaaagcagtttcgcttatttgattattcaacaaatctttattaacacgcattacgtgtaccagaaactgtggtacacttaactgtggagctggggaagcaaaagtgaacatgccgccttaagtgagttcagatggcttatcttccggttggggaggcatcaagtacacaggtccgttgtaaaccagtgtcttaagtgctaaccttatcacatttgctattagaggatattaaacatgtcagacttcttggagaaagttgatattttcatgttccaagtttgggaacatcattgaattcagacagatctggattgaaacagattaaagtgcctacactttaatagctgtgttcctctcagttaattgcttcatttctctgtgccttgtctgtacacctggattaagaatagtacctacttcataaagtataactaataatgtata

SEQ ID NO: 404154 - DNA, 434 bp, Homo sapiens
tccaacatggggtcacacctagcacctgggccctgtgcacctgagcttggaggtttgtgaggcagaagaagggcttgtgacctggaaaatgccatctcttgtgggtcacctgaacctgattggtgtcatctgtgtctgcttccagccagaaatatgtttgcgggagggagggagagagagcccctcctctagtgtctgatttgcactctgcccccaacctgtgccagctgggcacacggtgttcctcttcacatggtggtgactcccacagcccatgggaaggagtcggtgggagggtggagaggagcagaagttccagaagctccaagtgcagtgttcgcaagagaacattgtgactgtttatttccttcttcaaatgatactgatatttgataaataaactcaggaattttaaatttcatggattgagaaaa

SEQ ID NO: 404155 - DNA, 410 bp, Homo sapiens
aaatcattaaccctcgtgttctgagtgatagggggaaatgctaaggggagtcagagcctggttatcagcattttggatgaccatatattttctccccgtttcactatctttaagatgggaaaagtaattccagtgggatttattgtgaccagttaaacacagaattcctggagaagtaattagatgacagttttaaattgttatttgtaattctgttttggtagtaaaggctgcagaggtgatggtgaatagggtgggtagtttctgataatgggcttgcctttgacctaaatgtaggtaggctgggtgaggtggcttgcacctgtaatcccagcactttgggaggctgaggtgagaggattgcttgagctcgagaccagctgggcaacccagtgagatcccgtctctat

SEQ ID NO: 404156 - DNA, 450 bp, Homo sapiens
catacactccagaatttaaaacaatcagaatttttttaaaaatatgcctaagattctgatttttagggagaaaaataaatgatattcctccttcctcaaatatattaaaagattaaaagcacaaaacaacagagaggaaaaaaatggacatccgtggcacatcattgtcataacatgctacagatgtccatttctatcacatgttggcatattatgacaatgaagcagacagaaagctgattcctttttttttgctcctctaagtgccagtaaaggcatatcgatcaacaaaataggaagttatgaagagaaaatacttcaaacagaagcagacaggtttatagttcaacgcagagcatatgtaacaaaactaatatatttttataagtaaacattatttccaatgaattacagaaaacaggactgatagcaaaagcttaaagatactat

SEQ ID NO: 404157 - DNA, 745 bp, Homo sapiens
gatcaagggtttaagctgcaagtactcaatatttggctttacatttcagctactggccttcaacaccacggagagaggtgttttcctggtttttcagagctgagaagtgagctgtcttccaactcacctgcataggtggaagtcttcccagatgctgtgcttgaatctctaatttgatatatttacaagacttgcagaggctgtgagctgtgtgaatacattgcacataagaactacagatgttttaaagccttctgtgaaagtgattctgaaggtgtggtccctgggccagcagcatcaacatcacctggaacttgtgagaaatgaagattctcaggctcttctctatacctactgaatcagacattgggtgcaaaggggaacactacagtctgtctttaaggagccctcaagaattaggagcctcccaagctgagacagatctcagctactggctgtatggagttggatgagcttcttacctgacccctgggcttcagtttttcatctgcaagatgaagtttaccagagaatgggacaaacaggagagaagttcctctgcttttatgccagataatcttagatgaatgtgtgatgattttacaaggtgcacggaaaggactgtattgaattacatcatgagaaagttattcccttctgatcaactctctttccccagtttctacattgaggcaaagtctcagtttaatgctggaatattataacacttgctaatctttcttta

SEQ ID NO: 404158 - DNA, 615 bp, Homo sapiens
gatcaagggtttaagctgcaagtactcaatatttggctttacatttcagctactggccttcaacaccacggagagagctattgtgagtaatactgctatgatcacggctatgcaaatatctcttcaagagcccatttttcattctgttggaagaagtggaattgctgaccatatgccttctgtgaaagtgattctgaaggtgtggtccctgggccagcagcatcaacatcacctggaacttgtgagaaatgaagattctcaggctcttctctatacctactgaatcagacattgggtgcaaaggggaacactacagtctgtctttaaggagccctcaagccaggaacagtaattgcacagaagaaatccgatctctgatgggatgattagacactaaatatcatcctgcagataattacttggtacttctcaatcagaggtaaaatttgtcctgatgactctaaactttagccagcttctgtgtcgtatcccatgacttccaactcgcagcatcccaacagactttactcctctgctgttccatctcaagccagagaagactggggctctatgtcagtcctcgacttgataccactgaacgattttccatgagga

SEQ ID NO: 404159 - DNA, 777 bp, Homo sapiens
aggggaggcggccttcaagtaaattaaacctagtcttggcattttctcattaaatgcctgagcagctcaatcccaccggcctatataaggaccacggtagacagagcagatgattagcagtttcagaaccatcaaaaagatgcccacagtacctgacttttaattaataactattctgcatctagccatttatctcaagcatctgggggaacttgaaaggtatttctctccacatagctccagtatatcaaggttggggctgagcaaagctgatattaaagttaattatgacctgcaggaaattactgaaaaaccctcacctcattttctacttcttaaacttcaaatcacaattgtaagtttgactttcagaaccttctggaattataaacaaatatcttaaagagaaaactacatttaagtatttctatttttccaagggacagaattaggagcctcccaagctgagacagatctcagctactggctgtatggagttggatgagcttcttacctgacccctgggcttcagtttttcatctgcaagatgaagtttaccagagaatgggacaaacaggagagaagttcctctgcttttatgccagataatcttagatgaatgtgtgatgattttacaaggtgcacggaaaggactgtattgaattacatcatgagaaagttattcccttctgatcaactctctttccccagtttctacattgaggcaaagtctcagtttaatgctggaatattataacacttgctaatctttcttta

SEQ ID NO: 404160 - DNA, 356 bp, Homo sapiens
cagctacgtgggaggctaaagtgagagaattgcttgagcccaggaggtcgagggtgcagtgagctgtgggcacaccactgcactccagcctggacaatagaacaagaccctgtcaaaaaaaaaaaaaagatggatcttgacatgggcgttaaataaacctttgctaaggtgagccactgagattttgagatttattggctactgaagcgtagtatatcccatcttaacagaaatactgtaataatatttataaagtcttaaattatttatcaatggtttataagtaacaaaaaggtaaacattagtcaaatgcctgtcagattttttcagatctccaggttgaccatgcttcacta

SEQ ID NO: 404161 - DNA, 479 bp, Homo sapiens
gaaacagtctctctcactctcccatattagggctttactcacagttctcagtcagttgttggcatgcaggctgtctacccatcctctcttcactgggatctttccttttccagtgaattcctctgttctttcttgaataaaagattatagtgtgaatctctgtgcactattttgctttttccatgtgaaatatttaaaaatatttttaggagaaattagatgcagaccctgttcttttaccagtttcaaccaaaattatcttcactcttatctgttttataaattgaatttctataaaagattgtgtctggaaaaagatagattccactgctaaaaattgaaatagcactgattgaatagttaatatccaaattcctttctaggctgggtgttttttttttccttaaagaaatgagcattagaatcatggagtaaaaatacacatttatctctgcttgaagtcccactaacatgacaaa

SEQ ID NO: 404162 - DNA, 505 bp, Homo sapiens
taacataagcttatacggggttaaaaataccattctgaagatgtgtcttgtggaattgggtgtatgctctcagtatacaggctgattgttcctgtcatatttgatggcccttaatatggagaaaactgttctgttgatttattctcacactaacagctctcctttttggtcactgcattaattttagtcagttactttcttgcttctaaagaatctttttatcttaatggcagatcatttttagttagaagtaacacatatcctctcccatctgggtactgacagagtttggaaaagccattatctttatagtttaagagacagcttgatgttattgttacactttgaaagttaaagtttttaaggttgggtgcggtggctcacacctgtaatcccagcactttgggagaatcacttgagcctgggaggcagaggttgcagtgagctgagatcgcaccattgcactccagccttggtgacagagcaagactccatctcaaaaaaa

SEQ ID NO: 404163 - DNA, 360 bp, Homo sapiens
gtcgagactgcagtgagccatgatcttgccactgcatgccagcccaggtgacagagtgaaaccctgtctcaaaaaaaaataaacggtattgataatgatgatgattaatgatagtacaggtgatgataaggaagccttattggttgttgctcatgtgaaacactagggtaagcactttgcctgtagtatcttttcaaatcttcacatagtctccttttctatataacagttcgagaagttatgtaaacagagggctgtagattgttttcaaacagctcactgagaaaatagacaatttatatcactaactatattgtatgacaagtaacttctttatatagaatggcagaccagaaaagg

SEQ ID NO: 404164 - DNA, 497 bp, Homo sapiens
tcaggctccaaaagcataatacaaaatggaataaataccagttttatatggaatctgtcatatacaaattatcccaaagagctttacaaacaatgaatttgacactgatacttcagggatggtgtaaacaaatgcagcagccattgagtgctcagcgataactcacacaaagtcctccttgaaatgtcagaatgcatataccttcaccaggattctttcccaaaacatagtgtctgcttatgagcttgctgtcaatcacagaactccactcacacttagtagaagggaagtgaaaattccttaaagaactgataataatttgcacaggaatttcccaaggggaaacagtttaccaaagttaaatcagtttacttggtgccaggttactagacccatttcaacaagaaatgagatcactactgggtaggtttaaatatgactcttcatacctaccccatccccagtgtccccatgttgcttcatccccacacacacct

SEQ ID NO: 404165 - DNA, 346 bp, Homo sapiens
gcattttccagcccctgtcttctcagtatgtatgagatccacatgctaagacagtcatgctggtgatcaaattactttttgaacaagtgatcaaaagagaagaagtcctaatgaaatcctaatgaattgtatctcaggctacttacctctgacagtgcttactttattaagtcggctgtcaggaagcagcagggcctctcaccagtgtgcccagctcagggctcagcccactccaaatacagtgacaagaaagcttgagaaatgctgtcaacctcaggagggaggatgagaggtggggctacagaacccagacagctgagcccacagagagcatttggggatccac

SEQ ID NO: 404166 - DNA, 294 bp, Homo sapiens
aggcttatagctggtgagtacctgcagagtcctgagggagcacaggacatcacatggtaaggggctcacaaggatggctaaactgtcttttataacagacccactcttgccatcactaacccactcccttgataacccattaagccatgaatcgatgaatgagccctcataaccgaatcacctcctaaaggtcttttcaacactgctgcattggagatcaacttttcaatacatgaacttttgggggacacattcaagctatagcaccccatgatctagtacagggttgaagga

SEQ ID NO: 404167 - DNA, 342 bp, Homo sapiens
ttttttttttcatatctcaacatgacaaatctgtaagactggcaaggcaggcaatattatttctatttcacaaataaaaaatgagtccaaagttcatttttaaattaaaaatgtttaaattgggctatttattctgccttgggccaacatttaacctactcatactggcctttaccttttattatttttagtttttttaagacagtgtcttactctgttgccaaggctgcagtgcagttagggtaatcacggctcactgaagtttccatacttctgggctcaagcgatcctcctgcctcagtttctcaaggagctgggaccacaggtgtgtaccaccacacc

SEQ ID NO: 404168 - DNA, 185 bp, Homo sapiens
acatccatgatctgttctagaagttccaggttccgcccaccaggaagagcagccacaggaaggcaacaatgtaaccctacacagacacaccacaaaaacagcaccaggaacagtatctgtggcactaactggactctaaacccggtacttcctttaagcctcacagaaaccctaggagggaggtg

SEQ ID NO: 404169 - DNA, 482 bp, Homo sapiens
gagatgtgttctcaatgccaagcatcaacccttgctcctgcatccctgggcccttcctggtgatgtgacgcaaacatggagagctgaagcatggacagggcgtggcagggaggatccccgctgccctcctgcatgtggtcagcactcctgcttgcccctttctgggctagaaacttctagcccagttcctcatcttcctgtctcctccagagctcctccctccctaatttactcattatccatcagatggttccagactctgtgccaggctctgttttcagtacccaggatacaaacttgaccctgacttagaccccactcccaggagctcagcatctcagaggcggctaggataatcttttcttcctctcagcttcttaaggtctcagctacttgggggaaagacagttgtccattagtcattctattaaaatttcctaaggtttttttttttttcaagaacaataaaatgttttaatgtc

SEQ ID NO: 404170 - DNA, 505 bp, Homo sapiens
ctcaaattttctttctctgtaagaatgggaattaatgcccacctacgggttgcaagtgcttacaggagctgggcaagcaacgaaggtaagagttgtagagacttcggtaaactggagcacatgattcctgggaagcaggcctagtgtaaacaatttatttttctagaaaagacagaagtttagagtatatgaaatctaatttttaagtattggttggcaactaattgactatcgtctaccataaggttatatgataattattagggcaggagagtgaatgcatcttaatatgcatggcagaactgtgtgtttccttccatctggattttcataaagctttctgatttatcagtaacgatctgaaaaatgtactgtggcatgtaacatcttttattcattttattaggcattagaggaagaatattctgtagtcctgctttattctgccatctttacctggaaatccatttttataaaatttttgtaataaaaattcacttgatca

SEQ ID NO: 404171 - DNA, 658 bp, Homo sapiens
gatgttaaagagtcaattatatagttaatgtcttaattactcttatgataatgacaaggtaagggaatttcaaaccactcttcctttctacctcaaagcaagcccttggggaactcatctgtcactgctctatttgtaaagtttttcctgggaatcccagtgggaaaggagatgagggccacagaaataatagaggagggaagtgacaagggcaccagaagctttatgaccaagttctagggttcttgggtcatacctattgttgacctaaaggaaaaaactgaggcaaacttaacattaagtaaagtatatttggtcaggttttgaggacagcctttaggagcaaagattcaagttgccgtgaaaatacactctgattagcagcagttataagtaggggtttttttgtttgttttgttttgtttttgaagacagtttcactatgttgcccaggctggtctcaaactgctgggcttcagcaatcttcctgccttgacctcgcaaagtgctgggattacaggtgcaagccaccacaaccagcccacaagtaggtttttaaaggaaaagaagattggatgacgtgaagatattgaaaaaaaacaggctgactctgggcacactgcgtaggagttagccctgctctggaaggagccgcaaa

SEQ ID NO: 404172 - DNA, 345 bp, Homo sapiens
gatgttaaagagtcaattatatagttaatgtcttaattactcttatgataatgacaaggtaagggaatttcaaaccactcttcctttctacctcaaagcaagcccttggggaactcatctgtcactgctctatttgtaaagtttttcctgggaatcccagtgggaaaggagatgagggccacagaaataatagaggagggaagtgacaagggcaccagaagctttatgaccaagttctagggttcttgggtcatacctattgttgacctaaaggctgtcctcaaaacctgaccaaatatactttacttaatgttaagtttgcctcagttttttcctttaggtgtc

SEQ ID NO: 404173 - DNA, 151 bp, Homo sapiens
ggaggcccctgctggcccaggctgggcaactgggagctggcagaggcatgggttggcctgggcagcaggtgggcagcgtcatcctgactggaaggacgagcagtgggtcttggggtgatggactgggttgtgactgtggcgagtttagggg

SEQ ID NO: 404174 - DNA, 432 bp, Homo sapiens
aggaagcagtgggcccaatctggggagaaacaataggaaccttgagaaaaggagaggggcagttaagtagagaggaagacaaacaaggatataggggaggggagaggtagcgagagaaacagctccagcatgggctgaggagtaagtccagtagggtctagactccagtgtaagagtattatgtgagggcatagctatctggagtgaatctagcttatcaatgggaagcatagcatctgggaggcctaggtgtgggccgtgtatatttggcattttggccatggctcaggaactgaatagtaatagctactacttgctgagcatgtgctttgtgccaggtactgtgctaggcactctgcacacatttcctcatttaatctttatgaccctatgaagtaggtgagcctccctgtttgaccgatgaggaaactg

SEQ ID NO: 404175 - DNA, 1113 bp, Homo sapiens
tttttagaatgagctctttattgaatcaggatttgaggtgattatacgctaagcacaacactggatcctatctttgtctagcgcgtgtcttctcaaaaataaaagtgcaaaataaaaaacaaaacaaaagaaataaaagtgcaaattctgctctcagccgggtgcagtggctcacgcgtgtaaagacgttctcccctggtgaatgacttgtttttgtgtattttctttgtctctcgtgatgcatctgcactgacctgcagattttattttgtcctttttgcagactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacgg

SEQ ID NO: 404176 - DNA, 440 bp, Homo sapiens
cacggcattccactgtatgaatataccatattggttcatgtgtctccctcatcttcccaaccaggctgtaaattttgcacatctatagcataatcctatggctcttatcaaaagtctgagctcatatcaagtgaacactgaatggaaaaagttattattgctcggtttttttttgtttttttttacagaatctcgctctgtcgccccggctggagtgcagtggcacaatctcggctcactgcaacctctgcctcctgggttcatgccattctcctgcctcagcctcctgagtggctgtgactataggcgcctgccactgcgcctggcaatattttttttttttgtattttttgtagagacagggtttcaccatgttagccaggatgggcttgatctcctgacctcgtaatctgcctgccttgacctcccaaagtgctcgg

SEQ ID NO: 404177 - DNA, 380 bp, Homo sapiens
cttttggtcttccactttctctccttgagacggtatatctttttgtttggtgaggtgataattctcttttaactttttcatcttctgtaactttttttctccagctctaactctgctttaacggcctgacactgaaatgttctatcttgaaggcctagaaaagttgttttcctccagtatatcctgattctgtgctcttggctttcttactttctttctttcttttcttttcttttttttttttttaggagtactcattttttaatttattttagtcaggatattttctgaagtaaaatttcacagaaaacaaaattttattttacatgtacatttcatctctttaaagtcaagttagctctttttctttaaaaaaaaaa

SEQ ID NO: 404178 - DNA, 751 bp, Homo sapiens
tgggagcaggccctggttacagaattttctggggtttaaagtaccctctagaggtttcccatgggttatttggtgcatgccctatgtaagatgaaagtgacctgcgatcagtctgatggtgaggaaagcaggcaaccagaggctgaagtgaagttagcaaagttacatgctatgcaaatatctgattcattgtggaaagcaagcaatcagaggctgaagtgaaagttacaaagttgcactcctatataaatgaagagcttggccggagaccagcttgatggttgcaggaggggaccaatcagaggtactttcagttcttgatctgcttggtagaaaagcggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagcacgaggatggagattattctagcatccaaacttctctgttgacacgacaaagtcgggtacatccctaagtctgggcgtcgtgaaagaggtccaggaagcacggaataggttcctccttaccttgaaaggttccacggtcaccgtattaaccaccgggccaggacat

SEQ ID NO: 404179 - DNA, 389 bp, Homo sapiens
actggacattgtactgggagacacggaactcgaaagaaaatcgcatcgaaaggctgtacctggaggaaggaagtgcggagccagctgagttgggagaagagctccagagaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagatggagatattctaatttcagctactatcatttc

SEQ ID NO: 404180 - DNA, 411 bp, Homo sapiens
gtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgc

SEQ ID NO: 404181 - DNA, 300 bp, Homo sapiens
ccccccacccttcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagatggagatattctaatttcagctactatcatttc

SEQ ID NO: 404182 - DNA, 554 bp, Homo sapiens
agaccaccccttatattgtcttatgcccaatttctgcctccaaagaaagaagaagtaaaaactaaaagtcagaaatggaattcacaagcagacagcctggcgccacactctgggtctggtagttaaagatcaacccctgacctaattggttatttgcataagaaaaagcactgtgaagatccctgtcctgttctgttccattctaattaccggtacatgcagcccccagtcatgtaccccctgcttgctcaatcgatcacgaccctctcacgtggaccccgttagagttgtgagcccttaaaagggacaggaattgcttattcagggagctcggttgttggagacatgagtcttgccgaagctcctggccaaataaagcccttccttctttaactcggtgtctgaggggttttgtcagtagcttgtcctgctacacctgtaatcccagctactcgggaggctgaggtgggagaattgcttgaacccaggaggcagaggttacagtgagccgagattatgccattgcactccagtctgggtaacaagagcaaaac

SEQ ID NO: 404183 - DNA, 274 bp, Homo sapiens
ctttttttaaagctaggtgaaatgatttttaacagtatacttaacctatgtataaaaatatcaattcatttatatgtaataaatacacaattatatttcatattttttcatacgtattacaacatctggtgtgtattttatgcatacagcccatttcaattcaaagtagatacattttaaggattcagtagccacatgcggatagtagctaccatactggataacctaactctagtttccaagtaataacacaattaaaaaaaaaacaaaacaa

SEQ ID NO: 404184 - DNA, 528 bp, Homo sapiens
gcctatgcggggcggggccctggcgctagccaatggcaaatgttcttttcagcttcgctaatccccgtggccagtttgtaactccctagagtccagctggagccttcactcggtcctttggcccgccccgccttgtgggggcaggtctggaggtctgaagagagtttgggctaatccaggccccttcccggctcccacccaacccccactggccccaggagacctggctggagaagcccatgggttctgaaacctcctttctcacagtctgtgcccaaagatgctgcccactcttagtccgagtaagtgtttgccgttttgactctcctggggtcccaagtcgtgtccggcccgccccaccagtcaggaagattccatactgagtaggaaggcagagcaagggtctggtccccccaccacaatgtgtttggatccctagttcttcactggcaaaatctgccctgtctctcacaataatgtgagtctgagcagaaaatattaataataaacctaacactcattgcacgt

SEQ ID NO: 404185 - DNA, 572 bp, Homo sapiens
aaggaatactctagtgctactgactgactgcctaggctttgtcttttgtaaagacaagggaaagaaagccccagtgttagaaaactccttcccactttcattctctgcgagaagtacctagaaatttctagttattagactgtataacttgactctgctgtaaaaactttatcctagcttgggctattttccagatggtgtttcttctaggaggaaaaagaattgcctcaattgcagggaagtttttgctaatggtaagtcaagcaagtctcagtgtctttactacaggtaaaagggtgtaaggagattttatgagaactgaatgaaccctgaaggtcactagtcaaattcaggtatgctgttaagtgttcttgcttgagacccaaattacaagactggccaatttttgtatttttggtaaagactgggtttcactatgttgcccaggctggtctcgaactcctgggctcaagtgatccaccagcactttgggaggcgaagctggaagattgctagagcccaggagttggagaccagcccgggcaacaaagtgagacccccgtctctactta

SEQ ID NO: 404186 - DNA, 375 bp, Homo sapiens
acatagtagatgctaaataaagctaagaggtaagaaacagctgacagtatcaggagacagaaatgttctgggaggtgaggttggtaaggggaaggaagcgagggactctgagtaggacttgggggggatcccagcagagaccccttccaagatcagacttcccacccatgcctcccttcccatcaggcacttctggcctcatcaaacattctgggtgagggctccatctcgagagcttgacagaaaacctttccctgggattccacacctctccagggagtcccgggactctgcagccacctccctcccttcccatctggccaggccacggctgcagactatatttttgcaataaaaaaaaaaatcaggacttgt

SEQ ID NO: 404187 - DNA, 300 bp, Homo sapiens
gagatgaagtgttactgtgtcacccaggctggagtgcagtggcatggtcttggctcactgcaacctctgcctaccgggttcaagcgattcttctgcctcagcctcctgagtagctgggactacaggtgcgtgccagcatgcctgcctaatttttatatttttattggagatggggtttcaccatattggccatgctggtctcgaactcttgaccttgtgatcctcccccggctaagctgttgttatctttttgtttacatcatgttgtttatttgctttctaaggacaactaggtgcctg

SEQ ID NO: 404188 - DNA, 505 bp, Homo sapiens
ttcctgtcctgcattaattttccaaagttggaatatagtcatgtccttttatgctgtagagacttttctttcaccattactttctgatatctagtacacagtatttctttttctcacatctttgccgtttcaccacaataataaatcgggtgaagtgtgcacaatatctgtattttgaatggctatggcgttaggttgaaatggccaggcacaaatttagtctggtcattttgtttacacattgggaaaaaaattagtttattaaacattacctgtaactgtgtctgttttaccaagctggaaccttgggactttttatttctgatttttattacctgaatgtcagaccattttttcatgtgatgtacctagtgagtggagtttgctttgttttatggtatctgtactcctggtatattcaagcactgttttgaaaacagatgacttatttctccattaaaaatgcaataaaaataaatggcaaacaagcaaagtgaaactaaaa

SEQ ID NO: 404189 - DNA, 462 bp, Homo sapiens
aggcagccagctcctggggggagggtagccggctcaaccccctggaggccctgtgtgacctcagcctaggaggctgaagctgcagcctctgcccactgcgccatccttgcgaaggggctcccgcagaagggttggctgtgcccactaggagctggtcctgctgctcacttccatggccctggtggccttcatggagacagccattgtgtgcaaaggacggaaagtaagaggccccctccttctctcaccctttgtggggaaaccgaggcaagtgacaccttaagtcccagggcgctctgtggagcagctgagactccagcttccattttctgacttccagggagctatctttctaggtccctgggagggaggctggaaagggctcgtttcagaatacggttgggcaagtttgtttttctcaattctgcattaaaattgtctcgagtcatggttctgatgaca

SEQ ID NO: 404190 - DNA, 203 bp, Homo sapiens
cttaaatagaaattcctcctttcagcaaagttaaacaggaaagcagcatttagaatcacctcttgggcaaccaagtaacactaagaaaatgtttatctgaatatgatgaacttacaccacctagaaaactgcacagacttgggcagtgataccctatcaagtgccaaaagtatgccaagataagcttcataataaaattatgg

SEQ ID NO: 404191 - DNA, 989 bp, Homo sapiens
ggcaggtacgaggctgggtgttgaatcggccgagggttgagtcagcttggtggctccctgtggagccagggctgagcctggtcacgcgcactcgccaattaagagatggaccagccagcagtcaagtgcattctccagtccttgcaagaaggatcagccctttctgtgccagcctcgatcgccttgtgctttggtctctttttctcccccccgcctggatcctgcctcgcgcgggccgtcctgttgctgagactcggggtaccgttctgctgacccagctccctttagtcacgtttgcttggctctggtactaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatataggtctcttcaagtttttttggcttttgctattgttaccacttgtcactgtctccatgttaaaatgccaaaaatgatctagttgcttttgcttttttccctattttccacccagtcactccttaccatgactccttccctcagagggcacgtagcagtatctgtcccgccagtcccaaggccctgtgggaggagactggcctgcatctctctaagacttagtctgatgccatgcgcatctcttgttctgtgttcaatcagtagtccaggggagaagcttctgccacttcagagctttgctaaactatcctaacttgtctaaatctccccagaatcgccatctttgacccaagcttccatgcga

SEQ ID NO: 404192 - DNA, 747 bp, Homo sapiens
gctgggcttcgggacatggagaatcccatgagtcctcgctttcaagaaatgggggagatgggcaagtccttgctttcaaggattcccatgagtccttgctttcaaggattcccatgagtccttgctttcaagaaacagcggggctgggtgtggtggttcatgcctgtaatcccaatcctgtaatccgaggcagaaggattgtgtgaggccatgtgtttgaaatcagcctgaaaacacagggagaccttgtctctacaaaaaatcaaaaaagtctgggcgggggggctcacgcctataatcctagcactttgagaggccgaggtgggcggatcatgaggtcaggagtttacgaccagcctggctaatatggtgaaaccccgtctctactgaaaatacaaaaattagctgggtgtagtggtgcgcacctgtagtcccagctactcgggaggctgaggcagaagaatcacttgaaccctagaggcagaggttgcagtgagtggagattgcaccactgcactccagccagggcgacagagtgagactgcatctcaaaaaaaaaaaaaaaaaaaatcgaaaacttagctgagcatggtgatgtaggcatggcgttgtgtgttggtggtcccagccactcaggaggctgaggtgggaggattgcttgaacccaggaggttgaggttgaagtgaactgtgatcgcgatcgtaccactgcattgaagcctgggcaacagagcaagaccttgtctc

SEQ ID NO: 404193 - DNA, 441 bp, Homo sapiens
caaaactgtcaatctggttgttctctgcttggcaaaagatttttcaaaaatgaagtgaaagaaaaattatttagacaaataacaattgagatatttcatcactcgcagattggaactacaaaaaatattaaagaatgttcttcaggcagagaacaaataatataagatagaaatttagaaagatgaatggcaaatgccattcaattataatcatagaatgtagaagtcttttattctcatatataaatctcttttaaaacaattctgtgaacaaaataatacaaatgtgtatattatatcatagaaataaaaataacaacatcagtagcacatgaggagagaaacagatgtagaatcttaccttctttcaagatacataaaaagtagcattatatttgaaaataaactgtgataagttaaagatgtatattgtgatccctg

SEQ ID NO: 404194 - DNA, 1159 bp, Homo sapiens
taagacggagtctcactctgaaacccaggctacagtgccgtggcacaatcttggctcactgcagcctccatcttcgggttccagcaattctcctgcctcagcctcccgagtagctgagattacaggtgcccaccaccacgcctggctaatttttgtatttttagtagagacagggtttcaccatgttggccaggctgggctcgaactcctgacctcagatgatccacccacctcggcctcccaaagtgctgggattataggcatgagccaccatgcccagcccacattagcttttgaagggaatatttttatgttcataggaaaaaaagcatagctcctctatataaccaacttcttttagtactactgatagctagtatgttaagtttgatggactaattataatcttttttttatattcctagtatgctggattctatgattggcagatttaacatttatccttctcgtaattcacaaccctaaagttccatttactaataatttataattttgctggaacatgaatttgaatcttacatgcaacaattggattgagagttttgggagggcagtatgtgggacctgttcacatagtccatcagtctagcagccccatctcagtgtggctttgtttttgcaatttgactttgagtttgtggtaactcctgtggtgtaaatcattgcttcaggttctgagcaacagtgtatattatagctgcattgcaggtttcaggatttgcagggtatggggatgtatccaccattattgttaaagatttaccttagcagacacattagtatactcttctatttaaaaatcctttataagagtggtattatatggctatcctggtattctttcatattgttagtactttgaaatttttgctgatgttcaattagtaaaattaatggccccctaacagcagttgtactgtttgtatgttaaacttgatacatttagaagttaatgttaaagcctaatcctaaatttttaaaaggtgaaaaagtttttactggcaattgggtggccttgggacctgtgtgaagagcatagactgtagtttggtggaaagagcaaagactttgaagttctcggattctgtgtgtattctgctcctagcagagtgacctcaggcaaatgactttataggca

SEQ ID NO: 404195 - DNA, 999 bp, Homo sapiens
cggagcccacattagcttttgaagggaatatgggctgggcatggtggctcatgcctataatcccagcactttgggaggccgaggtgggtggatcatctgaggtcaggagttcgagcccagcccacattagcttttgaagggaatatttttatgttcataggaaaaaaagcatagctcctctatataaccaacttcttttagtactactgatagctagtatgttaagtttgatggactaattataatcttttttttatattcctagtatgctggattctatgattggcagatttaacatttatccttctcgtaattcacaaccctaaagttccatttactaataatttataattttgctggaacatgaatttgaatcttacatgcaacaattggattgagagttttgggagggcagtatgtgggacctgttcacatagtccatcagtctagcagccccatctcagtgtggctttgtttttgcaatttgactttgagtttgtggtaactcctgtggtgtaaatcattgcttcaggttctgagcaacagtgtatattatagctgcattgcaggtttcaggatttgcagggtatggggatgtatccaccattattgttaaagatttaccttagcagacacattagtatactcttctatttaaaaatcctttataagagtggtattatatggctatcctggtattctttcatattgttagtactttgaaatttttgctgatgttcaattagtaaaattaatggccccctaacagcagttgtactgtttgtatgttaaacttgatacatttagaagttaatgttaaagcctaatcctaaatttttaaaaggtgaaaaagtttttactggcaattgggtggccttgggacctgtgtgaagagcatagactgtagtttggtggaaagagcaaagactttgaagttctcggattctgtgtgtattctgctcctagcagagtgacctcaggcaaatgactttataggca

SEQ ID NO: 404196 - DNA, 340 bp, Homo sapiens
cactttgtcgcccaggctggagtgcagtggcacgatctcggctcgctgcaggctctgcctcccgggttcatgccattctcctgcctcagcctcccgagcagctggaactacaggtgcctgccaccacgcccagctaatttttttgtatttttattagagacgggattttacagtgttagccaggatggtctcgatctcctgaccttgtgatccgcccacctcggcctctcaaagttctgggattacaggcgtcagccaccgtgcctggctttctctttttcttagtaaatttcttccctaaaatatccagtgaactcgagtgtcagggatatgattagtt

SEQ ID NO: 404197 - DNA, 474 bp, Homo sapiens
cctctgcattgtcccttgggggtgctgggcaatcagggtggtggcacaggctgggaggggttgttggtgccctgcctcccactcagggtggtaccactccccagttctgccactgagacatgtctgatgaggcaccatttattcctctgtggttcataagacaacgtgtagaaaattagcattttatccctctagctgtattctgttaaaaatatatctaaaagcatcccatgcctgtaatcccagctacttgggaggctgaggcaggagaaatgcttgaacctgggaggtggaggttgcggtgagtcgagatcgctccattgcattccagcctgggcaacaagagcgaaactctgtctcaaaagaaaaaaagagttaaaaggctgttccatcttgcatactcctctcccccatgttggtgagattccaaagtgtagaagttttaacttttctaagctggaatttattagctgt

SEQ ID NO: 404198 - DNA, 314 bp, Homo sapiens
ctctacaaattaattaacaccaaagaatacatttctcctatactgattgttttgcagttaagcttgagtccaatttcccctagaagttgttgttttgatagtctttggacatactgtgaaatgtgattaagtcacccttggtagtgttagtttatcactacggtgaaaaaccatagagaaaataagaaattccatggaaattttcctagtaaccagttgtcaccactggcatcatgtatatagatgggattgttattgttaccgtatttatatgatttggctgcctatcaaaatattatatattttcaaaagtg

SEQ ID NO: 404199 - DNA, 408 bp, Homo sapiens
aaaaatagaggaagaagccctttctaactctggtcccaaggaacacctgttgcagatgccacttagtctcaagcttagctgtcatgtcctactcataaactcagccatcttccccttctttctcatgccaaccagtatcatatgtcaggctgaatatatccgtgctgatgtcagagaatcacataacaccagaggaaaacaaggccagccagaatgttgctacattttcagagaagaaaaccaaagcaaaaaggccaaaatatagcttccaaattttgcatattgtcattgaaattcaaggtttcagataaagtttgaaactcttgaggccaagtggcgagactgcaattacgttactttttagcagctgcagtttttttctaaatcaagtcatctcactttgttaaa

SEQ ID NO: 404200 - DNA, 517 bp, Homo sapiens
atgctaaccacatgactattgcttcccttattcaacccacccctgaatggcatgaaggctgttagctcagagtgaagaggcttttaaacgctgtcctgtagattggtatggacaggctgcacttccgatttatctagagagatataagacatgatccatggccaaggtaatggggtgggctcagacatttttaagttcctccagtaattttggtaaatagttctagtttttggaactatggctcagagcatcaaagagaaatgtagctcctgctcccatcctgtgaactttacacaactgcctaaagctatgatatctaatatggtagacagtagccactaggcacatgtggctattggccacttgaagtatgcatagctagtcaagatttcaaagacttacactaaaaccataatgttttggacatagggggttacataaaagtattataagacctaatttcatctttttaaaaacatattttaatgtggcaataaagcatttaaagttacataag

SEQ ID NO: 404201 - DNA, 587 bp, Homo sapiens
atctcccactacagacctgccagggcccaggagagctcgacccacccaggcacaccatagccccagagatggctggggacacagaagtgtggaagcaaatgtttcaggagttaatgcgggaggtgaagccatggcacaggtggacccctgagttcacacaagagaacatctcaaggatcctgaaaaacctggtgttccgaattctgaagaaatgctatagaggaagatttcagttgatagaggaggttcctatgatcaaggacatctctcttgaagggccacacaatagtgacaactgtgaggcatgtctgcagggcttctgtgctgggcccatacaggttacaagcctccccccatctcagaccccaagagtacactccatttacaaggtggaggaggtagttaagccctgggcctcaggagagaatgtctattcctacgcatgccaaaaccacatctgtaggaacttaagcattttctgctgttgtgtcattctcattgttatcgtggtgattgttgtaaaaactgctatatgagccttggaaacatgaagctaagtcagaaaaaaaatcagatacaaaaagtca

SEQ ID NO: 404202 - DNA, 818 bp, Homo sapiens
atctcccactacagacctgccagggcccaggagagctcgacccacccaggcacaccatagccccagagatggctggggacacagaagtgtggaagcaaatgtttcaggagttaatgcgggaggtgaagccatggcacaggtggaccctgagaccagacaagggccttcttcccaacgtcctgaagccaggctggatgcaataccagcagtggaccttcgccaggttccagtgctcctcctgctctcgtaactgggcctctgcccaagttctggtccttttccacatgaactggagtgaggagaagtccaggggccaggtgaagatgagggtgtttacccagagatgtaagaagtgcccccaacctctgtttgaggaccctgagttcacacaagagaacatctcaaggatcctgaaaaacctggtgttccgaattctgaagaaatgctatagaggaagatttcagttgatagaggaggttcctatgatcaaggacatctctcttgaagggccacacaatagtgacaactgtgaggcatgtctgcagggcttctgtgctgggcccatacaggttacaagcctccccccatctcagaccccaagagtacactccatttacaaggtggaggaggtagttaagccctgggcctcaggagagaatgtctattcctacgcatgccaaaaccacatctgtaggaacttaagcattttctgctgttgtgtcattctcattgttatcgtggtgattgttgtaaaaactgctatatgagccttggaaacatgaagctaagtcagaaaaaaaatcagatacaaaaagtca

SEQ ID NO: 404203 - DNA, 646 bp, Homo sapiens
aagtggttggaaagaagatgggggttgaccagaagagggcaggagggaactttctggggtgatgaaagttacacaggttcatcatgcagttacacaggttcacaattattgaaactcagtgaactgaacacttgaggctgtagatttcattgtattgcttctcaacgatcacacctcaaataaaataataataaataaacgcaatgcaatgctcagcacagagcgggtaacacggcaagtgccctagaagagttgctaaattgtaaaacacatttttttcctaggtgaattttaaaaagaatttactaggagaatcactttggaatatgtttggaaatctatttttttattgtgatgaaacatacatgccataacatttaccattttaatcatttttaaatgtacagttcagtggcattaagtgcatgcacactattttgctatttagtttttatttcataatcataaatttaactctgcaatccagctaggcatggaagggaacaaggaaaacatggaacccaaagggaaatgcagtgacagcacaaagattctaggatactgtgagcaaatggggagcaggcatgctctcctgaactataaaggaatggctgagtggtgaagataaaacacaagtctaatttat

SEQ ID NO: 404204 - DNA, 424 bp, Homo sapiens
atgatttctctgctttggtaagccagagtcagtttctgttgttcattactgaaaaccctgacatacagacacacacacacacacacacacacacacacacacacacacacacacactcacgcatgtcttccctgtccacttgttactggggcttagatccaatttagtccacagaggtgcatgcttagacaaaagctgttttttttctcagcaagttgtatgcttattgcatctgtgtatatatacgttaaaaagaaatgcacagacagaataatgcacaccaaaataaatactttgaaacagtgggtacttctggatactaggagttttttctctactggcttctaaaagctttctatttttctaagacatcataattataagaaattataaataaacataattataagtaattactttcatt

SEQ ID NO: 404205 - DNA, 333 bp, Homo sapiens
ggttaatgccaaccagactctttttttccccagtcacatagttgacacccacctaatctttcgtaacttctgtaattccactaaaaaaagatttaggccgggcacggtggctcacacctgtaatcccagcactttggggaggctgaggcaggcggatcacctgaggtcaggagtttgaaatcagcctggccaacatggcgaaaccccgtctctactaaaaatacaaaaaaattagccaggcgtggtggtagtggcgcacctgtaatcccagctactcgggaggctgaagctggagaattgcttgaacccaggaagcagaggttgccgtgggca

SEQ ID NO: 404206 - DNA, 294 bp, Homo sapiens
ctttctttctttctttctttctttccttctttctttctttctttctctctctttcttctttcttctttcttgtcttttttctttctccttttttttctttccttccttttctcttttcttatctttttctttcttttcttcttttttttctttctttcttcccttccttcttgtttggttgcttttttccttccttccttcctttttccttccttccttccatttccttccttcctccctcccttccttccttcctcctttctttctttcattctttctttctttatcattctc

SEQ ID NO: 404207 - DNA, 685 bp, Homo sapiens
cacctgattgccataagcatacaaaaagtggcttcggggatgaaataccattccaacgggagaagagaatgatgaaggaaaccgaaaaattggaaattttgattgtgaatttggttcattatttctcagggtgctcacagaggcaatggcagttttcctgacctaggtaaacaaagaatgagcaagtcataagactagtctgtgttacaaattttagaatttcctgttacttgcattttgattaagagagagatacaatcactaacacaacatagaactagaaggattagcagtaattgttacctctttactccaccactctggcccctgccacacacccatcttatagttgttgaaaatgaagtttaggagattaaataacttgttgaaagctctataattaacagcaaagagaggtttattatagaatcactgctgaacttgccagacagactccaaagcccatgcttatgactatcatgccaaaagtgtggatgcctaagccacaccccagttctattcaaccattattttaaatgggatcagaatatgacacctcaggccaggcgcagtcttcagcttaaaattatctttatataaaagtggcttgtaatctcagcactttgggaggcctatgtgagaggattgcttgagcctaggcatttgagaacagcctggtcaacaa

SEQ ID NO: 404208 - DNA, 568 bp, Homo sapiens
ctcctcagggactctgcagagagtccccaccagcaagaaggctctcaccagatgaggctcctcaaccttggactctcagcctccataactgtaagaaataaatgcctttactttgtaaactacacagttttcaggtattctgttataagcaacagaaaatggactgttttctttggacatccatgaatatggagagatggagcaaggctctctgaggaggaggagcacatgcttgaagaatgtgagccccagaactggcagccaatgtgagatggagctggccaaggactatagatatgtaaaggtcagggcaacacatgcttagaccataaagtgtatatattatacctgtcaaggtaatctatatttggggatgaaagtgaaggacaacatctcacatattcctgcttttcagtaaaaaaggacctgggaaagtcatcattttttcttataaacccagaataattcatagagaatgctaagagaaaacacaattgttgaggtttacacaagcaagtacatttttttttagaagtttcagtctccataatatattaaaagttgaaaa

SEQ ID NO: 404209 - DNA, 426 bp, Homo sapiens
aacatatatatacgaatagagctcatttaacctaaagcaatttctagttagggcagatctcaatatgtgatgtttgatgtaactcaatttttaggagaaaggctgttctgtgttctggggaaagctagtgattttctccaaagaacctggatgcagtctaagttaatgaccctttttgtggctaaatatctttttgatggattatcacaatgctagcagaaattactcttttgttccatcatactggtagtatggcaagagaccaaatgaacatctaagggttccatttgcctttatttttttttctcacgagatttcacaaaacaaaaaaaatgaggattatgttttcagtagtgttttaaatgcaatagtgaatatattaccgtgacaacttgcatacttttttctctttccctttatcagcca

SEQ ID NO: 404210 - DNA, 3923 bp, Homo sapiens
tcagttcttttcttttcatattggttgggttactttgagtctggcctacatgatgggcagtttagaggtcaaccaaaggatttcagcagaacttatacacagaatttcattcaggcttcccgtgtctggttggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgatagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcttgttatgatacggtcaataaaaccacttttataggaagaatactcacaaaaaaaaaaa

SEQ ID NO: 404211 - DNA, 3985 bp, Homo sapiens
tcagttcttttcttttcatattggttgggttactttgagtctggcctacatgatgggcagtttagaggtcaaccaaaggatttcagcagaacttatacacagaatttcattcaggcttcccgtgtctggttggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcttgttatgatacggtcaataaaaccacttttataggaagaatactcacaaaaaaaaaaa

SEQ ID NO: 404212 - DNA, 833 bp, Homo sapiens
atgtgggtgaaacatttagtaaagtatttgccaaccagtaaatgacatttttagcaaatcacttgactctgtgcctctataagctggcacatagtaagtgttcagtaaagttaacttctctgttattattgttgctattatgttcctaggttgtgtacacagattctttgaccctgtcttagctcttttttttttttttttgtagagcaagggaggtggagagggcaaaattaaggcacatgaaacatagagaaataaaacaatcatttctgtggtattgagagcggtttgtcatgtagcgatagagtgaaccacagtagctgatgaagacctgaacggagttgagaccaaaactggttttcaagaatgggttatttggatagatagagaggaaggacatgttaggaaataagaatagtatgagcaaatttctaaaaaagaagataaggatagtgtagtagaaactataacaagcaaccttgttgttgatcttgaaagtgaagtgtgggtggtaaatccctccatcattgttccccttaacccaagattagcagaaagtacataatatattctttttttttttgagacggagtctcactctgtcacccaggctggagtgcagtggcatgatcggtggagagcagtggcacgatctcggctcactgcaacctctgcatcccaggttcaagcaattcttctgccccagcctccttagtagctgatattataagcgcacgccactacacccgactaatttttgtatttttagtagagacggggtttcaccatgttggtcaggctggcctcgaactcctgaccttgtgatccgcccc

SEQ ID NO: 404213 - DNA, 556 bp, Homo sapiens
atgtgggtgaaacatttagtaaagtatttgccaaccagtaaatgacatttttagcaaatcacttgactctgtgcctctataagctggcacatagtaagtgttcagtaaagttaacttctctgttattattgttgctattatgttcctaggttgtgtacacagattctttgaccctgtcttagctcttttttttttttttttgtagagcaagggaggtggagagggcaaaattaaggcacatgaaacatagagaaataaaacaatcatttctgtggtattgagagcggtttgtcatgtagcgatagagtgaaccacagtagctgatgaagacctgaacggagttgagaccaaaactggttttcaagaatgggttatttggatagatagagaggaaggacatgttaggaaataagaatagtatgagcaaatttctaaaaaagaagataaggatagtgtagtagaaactataacaagcaaccttgttgttgatcttgaaagtgaaccccagtagctgatgaagacctgaacggagttgagaccaaaactggttttcaag

SEQ ID NO: 404214 - DNA, 381 bp, Homo sapiens
caaacaaaacaaaaaaaaaaacccagagcaaagaatcagtggatcagaaggaagtgaaggtcagtgagaagcatgacaggggagagttcagaaggagattcaacagatgtgttcacagatacagtcttcctacattctcatttcagtaagtctaggtatgcattcactcatccattccagtcattcaacaaatattagtgaattcctattgtgtgctactaggcccataaacacctacctttgtagcacttacattctaataagaccgttctccctcatagccattgcttccagtaataagtttacagaaactagggactaagatggattgaggtagttaggaaggtccacacagaaagataagtatagaaggggtacttt

SEQ ID NO: 404215 - DNA, 506 bp, Homo sapiens
ttgtgacagataccgtagtagaattcaagttgtctggctcctaggccggattcattcactgtgctaggtgttgggtcttttattttgttattcttcttttgatcggatttctctcatgccatgtgttgataaagccggaagtctgagatggtctgttttcaagaaactaagttctaaatgtagagctgcttgttgttgttgtcggtggtggtgtatgcattcaatttgaaggaaaatttaccaggtcaataatacacacgtttccacacatttttaaagcaatcagtgagctggccttttaaaatttcatctgcgttaaaacatccctctgccgaggcaaggaagtggacattgaggtattaagcctgtccttcagccaagcactgagggcccaagtgttagaattaaaggaaaaaaaatttcccattgtattaatatatttacaaaagaaaagtcataaataaaagcagtggccatgcctccattccatctgtgttcactcgcct

SEQ ID NO: 404216 - DNA, 425 bp, Homo sapiens
taatttttctgttgccttctatgtgacaaacatggttatacttgttaggtactagtaaattattagtaaaacaggtcatgatctcttccttcatgtgtcttacagtcaaattatatttctatgtatgcaaagtttgtatgttcaggaaagcataaagagtctatataattttattaagcagtatcataaaaagcatgagctctcaaatctgagttcaaatcccagctattcccctatgaaagctacttagcctctttccatttcagtttcctcatgtataaaattatacatacccctacaagattgccatcaacacaaattagataatgcctataaaatgtttggcacataaatgctctgtaaacattagttgttggtacttttaaatgtgttgttcacaaatcttctcaatgttgtatattgtt

SEQ ID NO: 404217 - DNA, 359 bp, Homo sapiens
ttttaaacctggaatgaattggctatatttgtgtaaattcagttgtcttccaaacaggaggaaaagtagagccctataaaccctttctaagaacttaaacaatagacacaaggaaatttccatcccctctgagactggcaccattgctgctgctgagataatactgaaagggaaacgaactttgtgcattgtggtttctgggagaccttgggatagtcactatttcttcactatttctgtgttcagttttcttttctccttgattaagacctaagtgattcattcattcagtcacaccgcctctgctgatgtgactttcttattacactgagcataaaaagtgtacaattcattacaaa

SEQ ID NO: 404218 - DNA, 1087 bp, Homo sapiens
ggtattaggttattccatgggctaatctcatttcctaccagaagaacttgctgtttagtggcttttccagttacggatctagttacagttagaggcaggattagaacccaggcctaaatctcatggtgctttagtcaaaagaaatttgctgtggtagaagtaatcctgattttgaagcccttcttaattgggtcttttattctctgctaatgagtacttggtattagaaattttagcaaagcagaaagaaatactggcctcactcagtaatgcactaacgtgtatatagataggaaagttttagatactctgaggtagtttagttctgcttaatggtcatcatatcctaaggtttttcaaataaatataaatggtaatgtaaaataaaaatcgaaaatgtttgctctatttcctggattatagctaaattaacctctctctctctctctctctctctctctctctatatatatatatatacacacacacatatatatatgtatatatatatatgtgtatatatgtatatatttaaaactttctgtatggaaaatttcaaacatgtcataagtataatgaactgtcatgtttgcatcacctagcttcaacagttaacaactcacagccagccttgttttatctacatacccacatacacttccttccccatatgttttgaagcaaaccccaggcataacaaccaaaaacatattctttgtatatctaaaaataaggacttctataaaatataagtaccgtaatattggtcacacaaatattaataatccatagttttacatatcagtcagtatatcagatttggccaattgtgacactattactatttttaaagtttgcatataatgcagggtacaaataacgtccttatgggaattgatcgatactgtataaaatctcttctaagctataagccctgtggtttacctatgcctgttttacaagtcacatttaaaattaaattttaatcctgctgagaacatagtgttcaaaatagctataaagggccaagccaggcctttctcagtcttgtaatctgtaggatgtaagtaggtcgtaccaagagcaa

SEQ ID NO: 404219 - DNA, 415 bp, Homo sapiens
ctggagaaatggaggtgaggacaggagagttcctcatctcctgttccagctcagaccttgtcctatctctatgccttcagctctttaagcaggacttagcttttcgaacttgattttgatctggctttggaaatgcagctgccttctgctgaaatggtcccactctccatctggtgaattaacttgcttttcatctcctcctccctcccttggcctgtgggtcaccgggctactcgatagcaccttggccagagaatcaatggataaggaagggaaaagaaggaaaacttagctcaactcttgttacctgaggcagcgactgaaaccaatgcccacaaagggggttttgtatttcccatgaatttaaaatgtttctgtcactcatgctaccaaatgtcctgagttggtgatccaa

SEQ ID NO: 404220 - DNA, 166 bp, Homo sapiens
caaggaagtattaattttataacccttattccttttaccaggcattaggtgaacatatgacatttagagtaaggtgttagaatagtcgtgtgaccaccttcccatatgatgatcattttcaaatgctattggctctgggagaagctgttatttcactagacgtttc

SEQ ID NO: 404221 - DNA, 163 bp, Homo sapiens
ctttctcaccaatttggggatcgttaaaagccctaacaacaaccttagccattgtgttattagaaatgatttttttaaacatgaagattaaattcttactgttttttaaattcccctgcatcttctcagagtaaaaattcttatttcttaattgtttcaggct

SEQ ID NO: 404222 - DNA, 453 bp, Homo sapiens
ttgatttctggcttaactctgtatcagaatttcttgctcggatcatttggtattgttaatattcgtctatgaaataagatgtttcaaagaattcaacatgctaaggcaatacttaggaaacactgtgcttcaaggtctgcctgtctcctctgctgaacattttaaataatgggatagggattacaggtgtgagtcaccacgcctggccaggccaccattttcttagagagttgcatactgtgcagtgtctgaaagcagtcatttgatatattttgttcaattttctgtatttttgccctggtaggaagtcagatctattatcgtttgctccattatggctgtaagcaaaagtcttctttttgtatttcatcagttctgtaatatttaattaattttagtattatatcattgcagcaatggcttcaactaccagaaatacttatattatttttt

SEQ ID NO: 404223 - DNA, 1241 bp, Homo sapiens
ctctcgtgatccgcccgcctcagcctcccaaagtgctgggattacaggcatgaaccaccgtgcccggcaattctagactattaaaagagatggtttaagagcatttagagaagaatgtaaccatagataccaacatgaattctcagtcaaatcctgactgactttatttcctccttgccaggttatctccaaagaggtagatttgggaaattttagacattgtatgtcttgtatgtatttactccagctgaagaccaccaagaatacacctggtaattgagcaagttgggtttaatgctcattgcagtgagggggagggctcaccattggggataacgtggtgtgtctcagcatgagggtgttaggaacgacttagagaacttagactttggttaagtgattttggggaagattcaagaaagtgggtgttcttttggattgggtgctgttaagggaatccaggataattgggtagcttgtctagaagaagggcagacaagtgaacctaagcacagtcgatgatgaagtcactcactagctgggaaaggggatgtttgctgttttgtggtttgcacactgaccttgttttgtgcttaaacaaaattgtgtagtgattttgttttttgtctcacttcatcgcagtcactgagtgaccttgtctgatgctggtgttttgtgagattgtttgtgtccaagagaactcattggctacctgtgagcaccaggtcagccctaacagctctgaagcctggctgtgtcaggccagttcccagattacaggagctactttcctctctctcacctgctaagtcatcacagataagaggaaaattacgggtcagttaatcgtagcattttttccatgcaaatggctctggttaaaaaataatgagaaaaaaatagtagcatttggtagaatcaaactgaacacttgtacttagtgttggttagcgcatttatgttagagaaatctctgttctctagtgataagcccaagggctatgttttattgtaaaaagaaaaaacccaactcgggtaaacatgtaaaaaacccatttatcaacagtaacacaggaagagctaaataatattcaaagtgtctgtaacttgaattgactaaaacactggagcactctcacactaaaaaattgcttagatcttgaactagtttgaggaacaatgttagagatttatattagcaataattcacatgagaacaaactgggacttccagttggctg

SEQ ID NO: 404224 - DNA, 662 bp, Homo sapiens
tatcctataggcctagcacaagtacacaataaaagttatcagttaattgctaaatgctacacatttcttgccagagaaaacaaagcaaattttgataacattaagccttctataactttgtgtatagaattttttttttctaagacagagtcttgctctgtcaccaggctggaatgcagtggcacgatctcggctcactgcaacctctgccccctgggttcaagcgattctcctgcctcagcctcccaagtagctgggactacgggcgcgtgccaccccaaccagctaatttttgtatttttagtagaaacggggtttcaccatgttggccaggatggtctcaatctcttgaccttgtgatccgcctgccttggcctcccaaagtgctgggattacaggcgtgagccaccgcgcccagcctagaatttttatgggaaataaagttcagttacactcttcacaaaaatgttttccattattgccaaactgtggaaaatttttttcaactaaaataggtttgattttttgcctttggttggttgtttttaaaattttcccccattttcaacaggaataaaattaagaatttttaagtaccaagtccaggaaaaaaaaaataactgtttgaaattaagggaaagctttcctaattgactattctg

SEQ ID NO: 404225 - DNA, 447 bp, Homo sapiens
caggatttgaatcatcacaagagattcaccagaggattttatacacttgggctgtggcagcagactaattacatcacagcactagagtcttcaccagctccggaaaagaatatttttaatcactgcagtcgcttaggataacagggttatctttggaaattcctgccctctcgtgtccagtatagagaactacttttgtgttctctaaggctgtgaatgttagcggacaaccaggagcattttagggcctcagcagaaaggagactgaaccagttccatgaaaacattctcctatctaataaatcaaaaaatcatgactggcttccatcagttcaggagtctccacacaaatgttttgacagtggaacaagagacagtcaaggacagttttatcagtgacatctaccttccaatagcaaaaaccatcaaccgcacggtaattttctg

SEQ ID NO: 404226 - DNA, 499 bp, Homo sapiens
acagctggaagcaggggctttggcttgcgccgtcctttcctgtaatctctcccgctctgggtaaggagctgccccccacctccacaacaagcaaagggagcacgtccatcggcagcgcggggactcggaggaaagcctgcgatgctgctgggggtgaggggaggtgaggggaggactgagcgaggggaaggacaggccccttcctggacagaaggacccgttgagatcacgtctgtgcatccagtccctataaaacacgagagctgttgtgcatagacacatggactctacagttcaagtgggaaatagtctcagaatggccagaaaggctcttgaaaggcaggtcgctaggacaagggagcgtcagccttgccagccactgggatgtacctgagtgtcactgagagtgaccttaatgaggagaatttggcatcgacagtgccagatcagacagaagctccatctgtgatggagacagcatccagatcatcggggagaa

SEQ ID NO: 404227 - DNA, 584 bp, Homo sapiens
ttgcctcttgctgatgagggatacttctgtctccctaactcagaatccagaggcatacttttcaattccccctcatttcctctctcctccaatgtctcctggagcctgtccttcctcttggtccctgatttcatgtgtgatcttgggtgagtcaatttacatctctgggtttcatgttcctcatccatacaagggtgggaatggccaccccattccatccatctggtatgctctaaatgtccataatatgttcccattcacaaaattctcccccaaatttgtgtccctccccaacccccaaatttatacgttgaaacctaatccccaatgtgacggtattaggaagtggggatttggggaggtcattaggtcttgagagcggagcccacatgaatagtattagtgcatttataagggactgaaggggccatagttctccccttctgccatgtaaatacacagagacatggcaccatccgtgaaccagaaagctgttcctcaccagacactgaatctactagtgtcttgatcttggacttcctggcccccagaactgtgagaaatagatttccgttgttaataag

SEQ ID NO: 404228 - DNA, 414 bp, Homo sapiens
ataaacatacttacttcaactttacattactcctaggatgtacgagaaattagtatgattaacagccaagaagcctgagagaattctgaaaactagaagcaaagatgaaaaggaagcacaacaggtacagaagagaatgaagacattctctgcttcaaaacttgtcagttttgcctacttgtgagtgccactaaaggcctatgaaacccttccactgtgtgacactaatgttgtatgggggccttatatccaaagttcaacaactgacagtgattgctctggaccaggatctacatcaccccacctcatgcatgccaaaagtattctcacagactcacacaactaagaatgaaggtagagtggtggactgggaagaacatcaaattcatagtcttacaatgatttattagaagt

SEQ ID NO: 404229 - DNA, 158 bp, Homo sapiens
actactgcgacataccaacgtgtatggaacagtacacccaagccaggctcattgtttaccactttcaggaaactatttgcaaacctgagatgggattagaacactcattatagctaacatttatttttttcattattaaactttattggatatcaaca

SEQ ID NO: 404230 - DNA, 441 bp, Homo sapiens
ggatgttctcaaaacttcgtgttaaaatttgatctccagtgttggaggtggagcctagtcaggggggtctttggggcagatccctcttgaatggcttagtgccatccttgagctaatgagtaagttcttgccctattagttcccatgaaagctgtttgttaagagcctgacacccctcgctcttactctctcactctctctcctctctcttgtttttcctctgaccacgtgaccttgcacacatctcctccccttccacttccaccatgagtggaagcagtctgaggccctcaccagaagcagatgtcggtgctatgcttcttgtacagcctgcagaaccatgaacaaataaaccactattttttaataaattacccaccctcaggtattcctttatagcaacacaaatagactaagacagatgcatttaagactctgcta

SEQ ID NO: 404231 - DNA, 815 bp, Homo sapiens
taaaatgtacttcatgtcaggaaggacacatttctaagtatggaaaatgaaatcattatttacagtaactacaatattctaagggattataattcaatgtgtcaggaaataaactggaaactcaaagactctcaacccttctgctcttagatttgccattataaataaaaagcaaaatgtgtgtgcatgtgtatgtgtgtatgtgtataacatccaagtattctttaaaaataaagcaacaaaattaatgagggaatagagataaggccacgtagcatgagtctaggtcaacaggaaggcattgttcttcccctctgaatggcaatcagatccgaggtccccagctaggttaccaaacatggtcttcctagctcattcacttaccttaaccaacaaaccaaagccttaccaatatgccggtgtttgagccgttcatagatcctcacatggtggcccttgacttctttcacagtgaggacctctgcttcatgaggctcataagaagaggagctaaggactattttgtcatgggggcgccaatccactgcatcttctactataattctgtaacagcataacaatggcattggatatactaacagtgcagcacaaatcatctattaactccagagcaagaaaaggaaatccactgtgaccaacatatcccaccagagaaactgaaatagaaataagacatggcagtggaaaaaggctttcgcaaacagtttaatttagctaatggagtcagttttctggcttgaaaatgtatatgttacagagacagtgaagatattcgatgacccctgaaatacagc

SEQ ID NO: 404232 - DNA, 1710 bp, Homo sapiens
catcttgtctgctccttactgtacatgtggctggcagagaagggaaggtggagccgctattttgaacatgattggcacaactgccagcatctatatctgcagcttgattttacaggctgctctttgttagaaaggaacatgatttggggctacttttcattaaaaggaaaactgtaccgaagacttccataccctcactatctgttttattttctaggtttgggacctctgcgtacctcctgtggctttatggtacctggtattgtttccccagaccatgagtctccagtgttggagtgcccacttcagaagtctgtgtgttttgcttcatcctgaggatcccatcttggataccacattaccttaaacactgcctcagccaggtgatcaaggtcaacgtctactgtgataagtcatggttttggtgtgtacccttgatgtgatgtgataaaaatggcactttacctctgtggtcttcctctgaaaaatcccgtaacagcagcctaatcatgagaagcatatcaacaaaactcagactcagggacattctacaaaataccaggctgtccctccctgaaattgtcaagttcaccaaaaacaaggtgaatctaagaaacctgttacagccaagaggagcctaagaagacatgaggactaaatataacatggaattcgggataggattgtgctacagaaaatgtatgtgctaatgtgagatgttaacagttggagaaactcagttttgggtataaggaattctctgtactatgtttatctaaaaacaattccatggtgagcaaacttaagcatagaaatgttaaataaattgtccaaaatagagaagtaaatagcagtgccaggtttcaagcataagaatcatcaactctgaactttaaacacagctctgtatggtacttttgtttatatcaatgcctagatagataaataggtagatagataatttccaagtgctagaaacaaaaaaggaactaaaactgataaagaatataaatgaggccaggcagggtggctcacacctgtaatcccagcattttgggaggccgaggcaggcagatcactgaaggttcggagttcaagaccagcctggccaactggggaaaccctgtctctactaaaaaaaaaaaaaaatagccaggcatggtggcatgtgcctgtgaagcaagagatgtgagaggaaaaacaaatttttcctctttcttttggtatgggcagcttcccccttgaatccctcctcactccttgtgattttaccctgctctgtaagttttatgagtttatagattcctgttttctgtaactagtgtctgtaagtctctgtagcaccgtggaggtaatgagacatgcttgagcaagcttagattgcagccatctgggcgccatagcgaaggacacgagataaggctgtgcaggcatcttgagcaaacctagataacagccacctggcctgcacagcaagaatcatgtgtaagcttgagttaggaacctgtcacagtttgattaactgcctttgttctgcttctgtaagcttgctttccacaccccacaagctttgcgccactggcaagccaccctccttcagttgcatgaataaaagtcaagccctgtcttcttttgttgctcagcctctggatattaatccactaagccagtggcaacctaaataaaatcctcctgttccacacaaaaggt

SEQ ID NO: 404233 - DNA, 416 bp, Homo sapiens
gacttgagttcatgtgtcattcaccaaagtaaggtcctgctttataataataaaagatgcctagcacaacagttcactcaacagagctctgtgcttattgatctgctgagttgaactgaatctgcaaatccatagaattacatgagacattttaagttacattaaatttctgctgtgtgcttttaaatcatggagtgcgagacccatcagcacttagggtatatttattaccttaacaaatgtcagatgattgtgtccagtgctatctattatttatgaataacaagaggctgtaagactggaaatgacatgctttaatacgtccaaaaggttaggcataatgcagtttgctgccctataaatttctcgacaccattttcctttctaataaagcattgtcagtggttgactatacc

SEQ ID NO: 404234 - DNA, 321 bp, Homo sapiens
atttatttatgtaaaaaatatttaacaacaaacacatagtaccagacacccttctagacactgaggatgaaataatgagtaaagtaaggaaaacaaggtgccttccctccttaccttctagtggaggagacaggcaataatctaataagcgaacatatctacttggttttattaactggaccgcagttcataacagcaaaacagtggatgaggtgggaacaccaatcaaagagattggaaggaatgtgggtggcagaatactacacagatgatccgtgattctttagacggatttctttgggggagacaaaaaaattctag

SEQ ID NO: 404235 - DNA, 350 bp, Homo sapiens
agaatatgttttcctgtattagtccagacctcttgagactgtagtttacgactccccaggaagatctcggcccctctaaaaagccagaagatcaaacaccacttagaggttacggttcattctggctgagtatggtggctcacacttgtaatcccaacactttgggaggcctgagtgatcacctgaggtcaggagttcgagatcagcctggccagcatggtgaaaccctgcctctactaaaaatgcaaaaattatctgggcatggtggtgctcacctgtaaccccagctattcgggagtctgaggcaggagaatcacctggatgacagagcaaaaactctgcctcaaaaa

SEQ ID NO: 404236 - DNA, 528 bp, Homo sapiens
tcaccacacactgtctcacccagatcaacttctagacttgcaagtttcattcatggtaagttccctatacagctgtagcatttaaaaaatgtttatgccatatttgcacagaaccttttctatatttagatatgtttagacatacaaatccttaacattgtgttacagttgcttgcaaaattcagtacagcaacaagctgtacaggtttgtagcctaggagcaataggctataccatataccctaggtgtttagtaagctgtaccctctaagtttgtgtaagtacactctatgctgtttgcacaacaacaaaatcaccttatgacacatttctcagaatgtatccccattgttaagcaacacatgactgtaactgaactgcctgatagaacaaaagtcaacactgacagtcttcagaggaagataacagaattcaaagtccctaataatgtatcatccacaatgtccaacatgtaatgaaacgttacaagacatgcaaagaaacaggaaaacgttacccatatcaaga

SEQ ID NO: 404237 - DNA, 1596 bp, Homo sapiens
tgcagttcttaaaacaaaacggccaggtgcggtgtgtgacgcctgtaatcccagcactttgggaggcaaggcgggtgaatcacaaggtcaggagttcaagaccagcctggccaagatggtgaacgcagtctctactaaaaatacaaaaattagccaggcacagtggcgggcacctgtagttccagctactcgggaggccgaggcaggagactcgcttgaacccgggaggcggaggttgcagtaagccgaggagggccactgcactcctgcctgcgacagagcaagactccatcaaaaaaaaatgtaatttaaaagattaaaagttaagatagatttttacaaatgtatatatctaccattatagtatcatacagaatggttttactgccgtgaagattctctgtgctctgtgtatccatctcttccttccccttggtccatggcaaccactgatctttctactgatcccatagtttcaccgtttccagaacgtcatataattggaatcgaacagtacgtagacttttcggattggcttcttcttttagcaatatgcatttaagtttcctccatgtatttttttgtggcttgatagttcatctcctgttagcagtgaataatatcccgttgccattatacttttgtcaagactcagaacgtacaacgtgaagagtaaacgtgaatgtgcactgtaagctttgagtgataatgaaggatcaaggtaggttcctggttgtcacaggtgtgctcctgtgaggcaggaagctgtagtggggaggctgtgtgtggggaaagggacatatgagaagtctgtactctctgctccgtttagctgtgaacctgcacttctctaaaaaataaaattagttaaaattaaaagcaaaaaattagaaaaattaaaacattacaatgtgtcatatagttttcaaatcacaagacagaaaaagacataatagaagaaactatagaaaacaacaaggataggaataaaacctcagtgatagaagacagaagacagaagacagaaacgtggagcccaacacattaatttattttaatcattagttatactcatttatactaatttatattgatttaacatattaattctgactaaatggcattaaaggaggtctgaggaatttgcatgtcacattctggatgacaggactcaataatattaactctttagtttgctgtaaatcatttaaaaatatgctcaaattccaataaaaattccaagaaaaatattttcgaacaagaacatgtgattttaaatccatatattgaacacacacatacaatgagagccattattataaaatttactataagatatttaagattattatcactatccaaaattaaacaaatttgaaatggcacaaaaataaacacattaatgaaagagaattaaaaacacagaaattgagtgtaattttatctagtaacagggtaacattttaaacccacaaaacagagcgattgttccatttgtggtattaaaatattgggtaatgatttcagaatataaaatgacagaattgaatcatggtcctacaccttacataaaagttaattccagtattaaatgta

SEQ ID NO: 404238 - DNA, 452 bp, Homo sapiens
gaatcacttgaacccaggaggcagaggttgcagtgagccagttgtgccactgcattccatcctgggtgacagagcaaaactccgtctcaaaaaaacaaaaacaaaaacaaaaaacagtagaaccaatacctggttctttgaaaagataataaatttgataaacctctaacaagaccgacagtgagaaaataccaaagacacaaattaccagtcaggaatgaaagaggccaatctctatagactgcacagacattaaagcatgataagggagtactatgaacaactgtatccatatctggtcatatgcccagtagatgtttcgggcaacgattgaccacatatataacagtggctccatgagatcatgataaagctaaaaattcttaccacctagtgaccttgtagccattgtaacacaacacattactcacgtgtttgtggtgatgctggtg

SEQ ID NO: 404239 - DNA, 435 bp, Homo sapiens
ctgatagagcaatcatatgggattttaaaaatatagttccaagtacattactaatggacaaaaggaaagctgaaatccataaaatggggtaaaaaaaactcctcctcccttttttgaatttttaaattttttatttatcttgaaattctggtttaatttgcaacagatctagaaattcaagtcaatttaacaaacatttgttgaattcagtaaggcttcacagcctgaaatatcaatcaaaattacttttttttaccttatattcctttaatattttgttttagtcctacaatccccttgtaacatgatatgctatatttgagttattgtcagtaataataactgacattttaaaccataattgtctttgccaaatactatgcatgctaatcaccttacatactttgactaatcttttataaaaacatgaaaccc

SEQ ID NO: 404240 - DNA, 512 bp, Homo sapiens
cagagactttgcaatgtgcaaggcgcaccaataaaggaatcccactacaccatttccctaccaagagatacctggcagctggcctggggaaaacccttctgctttcctcaggcaggaccagcagagacaagtgggaattccagcagcaccacacaatccaagcagaccataatccaatagcactccaaaggctgtgaaaattaagctgccattggaatcacagcccacaaaagtaggacaagatctacatgctaaacctaaactgtgtgactttctgctaaaataaaaaatgtaaagggaactcatcatcttattacataatatataagatatccaggatacaactgaaaattacctgttatacctaaaacccagaaaatcacaactacaatgagaaaaaaaaaattgacaccagcaccaaagtgattcatatgttgggatcatacaagaagaattgtaaaacagttgtcataaaaatacttcaatgatcaacacaaatcctctttaaaatg

SEQ ID NO: 404241 - DNA, 495 bp, Homo sapiens
tctggaatgctggaaggagccaagagcagatgccatcttggtgatgtgtttcatcttcaggacctgagacccatctggtcaaatatttgtgtgtatatgcaaaattttaggtcatttgttaaaaggagctcatgaatacatgtccttgacttcccagagatggaaaaaacacttctctccgccaaagaacttccaaatagtgcttctagcctatgctcctcatcagtgtccatgtctctcagatgtctctagttttggttgaggaatgaggaaatgtggttgcctccttttattggctgattcgtctgctgagctcctaacttcttagctaatctaggtgaaaccaacccttgtcctggaccctgggcttttgtggaggactgtcttactgttcacaaatactccgccttttccatgagaagctaatttatccctgcctgttgaaattgggcatggacaatgacttgcttggttgtctaataaaatgtgagcaga

SEQ ID NO: 404242 - DNA, 499 bp, Homo sapiens
ctgagggaagcataagaggaaaggcccttagagatagcccttaaagttctgcaacagagatgaacaaacaagacttttgggtgcccagggaccacagtggcactttggggtgggaagtgtgcagaaaaggaatatctggatgcagctgaagttttatgtaaggaaaaggctggagataagtctgtaacagaaattccctctagctagcttcattcatgtaataaataattaggcccattctgtgaccagacactgtgccagcttttccacatttggtgttgaacaaagcagatgtgttccctatttttttggaacctacagacatttacaaaataaacatgtaggaatacattgtgggaagtagcgtggagaagaacagaatgctgtaagaaaaaaatcaggggcactgactccgttttggtgttctgagaaggcttgctctttgacaaagaaagatttcaattgctattggaaagaagcataggggttaacttgacta

SEQ ID NO: 404243 - DNA, 329 bp, Homo sapiens
aacccatagaaatttatgaaatattgatgccaacatctgcttctgaccatgaaggatgaactgttatgggaactgcctctcaccataaacagctagaaaaccagacaaatacatgaaacaactgttttcagatactgggaaatagcagagcaagcctgttatcctgagagaagagaaacaaatgaggtgagccctacaattgcccagtttgctgcctggaggcagtttcagtacatagtgcaggaaagagaacccaaacaagacccagcagtctcactgagttgaggacagaaatcagaattccagaaagccaattgcaggcaaaatac

SEQ ID NO: 404244 - DNA, 124 bp, Homo sapiens
tggaattattatgggattaggtggtatgcagtttttaaaattatcaatcttccattaattaaccagatgtgtgacatgtggcaaattgcttaacatctagaaaaattagtttcttttaaataaa

SEQ ID NO: 404245 - DNA, 351 bp, Homo sapiens
aaataattggagaacctggtgaatatagttaaaaatttcaggtgatttatttaataacaaagaggaaacagaattattaaagaaagtataatgcacgttggaagtacatggagtaaatgccacccattccctttagtctttagtagttagtcatggctctcttaattagcttcttccatacatttttgggattatatcccttatgaccagggatttagtgtagctactttgaaagatgctgaaacttcatgatgaatttaaaatgtgtgccacgcctttcccatacatttgtcaggcagcctctctgtgtatcactgggtttttagaaagccaagccataggattattcac

SEQ ID NO: 404246 - DNA, 551 bp, Homo sapiens
gcgctgtcatgtctggaggagttggtggaggcttggggagcacttgtggactcggtagtgggaaaggcagccctgggtcctgctgcaccagcattgtgactggaggctccaacatcattctgggctctgggaaggaccctgttttggattcctgctctgtgtctggctccagcgctggctccagctgccacaccatcctgaagaagacagttgagtcgagtctgaagacatccatcacctactgagcgacccagcagccacctccttcctgaacacatttggcccactccccccatcagccggctctgcaaggccaactccgtgtccgctgcccacagcccaagccagcccacagcggatgctgcaaaaatcaataaagtctcccctcctgctgttctgaatgctctaagtgcttgcacacctcacccagcaaaacaaaagctgtgtggctccccagcttcctctcctcggaaggcaattgtggcatatctgtgtccagacgtgttctattggtatctcactccacatcccagccactctatcaagggatc

SEQ ID NO: 404247 - DNA, 794 bp, Homo sapiens
ggctggtctcgaactcctgaactcaggtgatccacctacctcagcctcccaaagtgctaggattacaggcgtgagccactgcgcctggcctatcccattttatagtaggagatattgaacccaagagagttaactaacttgccaaaagtcacacagctattaagtggccattgaattgcagatctgttttacttctgatgacatattgaaaatttatgcccttacagggcaaggggattctgtctattgctgctctatccccagcacctagctagtgtcttttggctttcaaatatttgttgttgttaaatggcataaagggacttttgctacacacgttggagatgtgcagatgactgatgttgccgaatgtttcccctactacgttttgtccgttcccaggctgctcattggctttgaccgaggatggtgacgtagatacggtaaagtgctttggtgctttcccatttggtttgaccctgtggttacccagtaataggttcaggatattagaccttgatccagaagatccaaagatgaggataaacctttaaccattgcaacttaaagcccctgagagttgatattccctgtggaggagaattgtattgatttttcagaggtaaaatttagggaaccacatgttcatactattcgattccccttgattcagtctcttacccctcctcctgtttcatggacatttcagtgttgccagtgaaaaagtaatggttttaatttggtccttatttttaacctgcccctgagacttatatgcttgtttataccatgta

SEQ ID NO: 404248 - DNA, 475 bp, Homo sapiens
accattatcctccaattgccagaccctgctagtggcacatccatcagtacatgaactgaatatgtcacagagtgtatcaaagctaaggtaggtgcctgtcccaccatcagttgaatgagaaggtttctgatatcagaaattgggctaccctgctttgccaagactctcttttccaatctctcaaaggcagataataacactaatggacaatgtggccatgagcattaaaacaaatcattaggctggaggcttctcatcagtgcttgagggcaatttcaccacctggggctttccgagaaggcttttgaaggctctgaaacatgctcagtctgcaggagtatgcaggcacccaccgtgccccaagatatggactgtggagcgttcattgtctcaacaattactcactgcaaggtattttcttatggagttgtttttgttccccctaaaatattattacagaaaagaaaactgcatt

SEQ ID NO: 404249 - DNA, 1372 bp, Homo sapiens
cagtcagacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattg

SEQ ID NO: 404250 - DNA, 1204 bp, Homo sapiens
cagtcagacaccgagtctcgccttctgagattggcgggtaacctagcaacgcagggaccgcggcggtaactgtggctagggaaacctggagcggtcagagcagaatgctgtctgtatgcctggctggtccccgcctgacacatgtgcctgagatgcctccacacttggtcttcctgcccttgtggccctaacaccctcacaaagctgaaaactgcttccagtgaaaggttctgtgtaaaagcgacagaggacctaagatgaactcttgatgtcaacagttgtggtttctgcagccacactaaccacacagatgtcagcacagctgcactcacacctacttcttcattttgcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtggaaaaggagaactttgtgatccaaga

SEQ ID NO: 404251 - DNA, 1082 bp, Homo sapiens
cagtcagacaccgagtctcgccttctgagattggcgggtaacctagcaacgcagggaccgcggcggtaactgtggctagggaaacctggagcggtcagagcagagtctcattctgttgcccaggccggagtacagtgatgcaaacttggcttactgcaacctccgcctcctaggttcaagagattctcatgcctcagcctcctgagtaactggggttaacctgagtaacaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggtggaaaaggagaactttgtgatccaaga

SEQ ID NO: 404252 - DNA, 1787 bp, Homo sapiens
cagtcagacaccgagtctcgccttctgagattggcgggtaacctagcaacgcagggaccgcggcggtaactgtggctagggaaacctggagcggtcagagcaggatggccagagacaataaaagcacgagacccaagtagtctaccgaagtctccatctctgtggacctacagaggcacagagggctgctcacaagatggctttagacattctcgccatggcccctttgtatcaggcccctgccatcaacagaatagggccaaagacagacccatctaaaaggccagctgatccactaaaacccttggttctctctaggaccaaactcaccaccattgaggccaaaaggatcatgtccatcctggatgaggcgatctacaaggtggagctggtgaccttgctgtcgtatgtggcatccaacagagaggatatggaggggatgctgggggaggacgtcatgagggcagtgagagagcatgaggatctctgccaggtcctccttgaaaacgtcaggtgcctgaaagagaaagaaaggcaattgcaggagcagaaagaggctgaggaggaagggtggctcagagaccgcctcctttccatagagctgcagaaatccagcctctcaccacttatgcagcagatcaaagactccaccaagaacgtccttagactcttgctcagcaacccccaggctgctaggctcctgcagatgcagacacagggtagaagtgcagaagcccagaattttattgacagcctgatagagctccgtggtttcctgtttgaaaaactactcactagtcccatggaagcgagggataaggcccagttcttacaggatatcagtagacagaatagtaataaccaacaaatcattgatactcttgaaaaggaattggcggagagaatgaagaacaggaatgcagaggaggagttggaggatctggacgctgttcacagggaggagaagatctcgctggaggagctcaggcggaggcacaaagtgctggtgggagagtttgcgcagatccgggaagagcgggagatcaactccaagaaaaggatggaggcagagcaggagatggtgcgcatggtacgggcggccacgctcatccaggccctatggaagggctatctggtgcgctccctgctcagatccaagaagaagcggggcaagggcaaagcaaaggacaaggagaagggcaagcagaaaggcaaggagaagggcaagggcaagaaatgagctctccacccagcccgctcctgacccttatcttcccagagaccaggccaggaaggcccgagatggagagcactaaattcacggctttcatgtttttatttaataaattaaaaagtatttgaagccacattgaagggaacgctctacgaataaatctctttacccagggctgtgggctgtgtgtgtccagctcacagatggtgtttccatgaggagcgtgcagcctggggtgtcagcccagagattatggttccttacttcagccttagtgggaaaccagaccccagctgcagcccggaagctgccatggccatgatggacacatcactcaccagggcagcggggtgtgggtcacagctgcccatagggggcaaagaagcaggcagggaactccaggaggagcggggcctcaggtttcaggctgcccctaaccctgttctgggattaatttgcttgcaacttcccctgctctagcactgtgaaagctcagagggagtcctgaggtcacagcagccctcagcctcacattccagggagctgaacaatt

SEQ ID NO: 404253 - DNA, 679 bp, Homo sapiens
gaataagatctgatgctacaacatagccttcctaatttctcaaatcttacagatagattatagcagacttagactgtatctgactacataatatagtagaataaatattgggaatgcagttatagttttggataaaaaagatccaaatgtatgttcatccttttacttagctaaaacagctcaaacaagtaaaaattaattctctaaatgtaaatattcttgtgtataaaatttgaaaatgatgatacctgacattgttaagagttataaatatgaaaatagctaatgcatattaagtgtggtggacactgtgttatgtgcccaaattctctttcaggattaaagatgtatttgtccagccactgaaggtgtcactatatgacagccctcagatgttagacttgaccaataattttcctgaactgaaagaacggtctctgccttatctaagatgatacacttcctagggcagccatcatctaataactcgaaatacgggacgtacttactagaagaatggaaatttttgttatccagtggcaaatatttgattaatgtttgtcccagagcaattttggaagtagatgatttatcacatgaatctgtatctctaagggaagaggatctaaaagagattgttagttacagccatcaattgttgttggcaagatattacgga

SEQ ID NO: 404254 - DNA, 538 bp, Homo sapiens
tgtggtgaggttgcttctttaaatgcgaccctgatacattcctcctccctgggcaggtccttccctctggagcctccagccacccctgcctgtgttctgttgcggaaagacttctaatttctccttggggcagagtgcctgcggagtggggcgggccgccgccttggctgtttgtgaagcggcatcgttgtctggggtatgatttaatacactttaccgacctgaattcattggatatatgtaaaaatgaaggaatgcacattattctgcttgatgctctgcagagaggagctgcctgagaggttgcacctgcagtcctggatgcactggccccaggggtggttggtgctgactccacatttgtctaataagatgtccagatacaaaaatgtctgtgatgtgggaaccgttacagatctaggagagttttttcaacagcaaaaaaagcaaagcctgtttctgtcaaagtcttttattttatttttgaatttgaccttttaaaataagattaaaacattccatcaagactccctttaaa

SEQ ID NO: 404255 - DNA, 409 bp, Homo sapiens
tacatgtttattagaaaataagtagttgctatttgagaaatgtttttaagttcttagagaaaaacagtatatgcagaagaaatctggaaagctctatatcatatagcattaaaatgcttgttaatagaatattgtagacatttgctgaatactgctaaccagaggctgtagtcttaaggagaagcttaaccaacctcttggtttcggtttcagtatgttcaaattcacttgggtgtttggtagcatacctttactgaatctaactgggcattaacatgacagttgattaaaatgaccttgtaataaatacattattatctgaagacttatgaatatagttaaggctttactgtctatcctaatgttgaaaatctaactcagttttcccaagtcctaggtttcttgatgg

SEQ ID NO: 404256 - DNA, 520 bp, Homo sapiens
gggaaggggttggagttgagtgctctgttctgtggagataacaaagaagcccttcttccttcctcttggatgacctgaccatactttgcagcacaaatgatatcttaaatcttcagtcgcgttgggattggcaaggatgaggggctgtgtgtagccaagggaggcccagacatggtctctgtgggaaatcaaaatttccagcttctctgggctgttacgtcttctcccatcccttgtcactccaccttctccatctctttccatgtgcttctctcagggaaaggcaggcagcctgaccctcagatccttcacccggctcagtgggttacttggggcctcgagttctgcacactagagatcggtgatccctcagggctgggagaggaatagcctgggagactgtcagggtctctgtgatgactgagagtttggtgtatgagttgatgagttgggatgaaccatggtgatgatactttttaaatgaaaaaaaaaaatcacgttgtccaacaaagcattttga

SEQ ID NO: 404257 - DNA, 514 bp, Homo sapiens
tctgaaggagctaagagaagaaactcagagaagttaaaagaagtggctagctcaaggtttagatgtcggcttaggaggcagcagtctaggttcaaccccacctctgcaacctgcaactgcgtaacttttggtgtgctactacacttccctaagccatatcttcatgtctgaaaatgagatgacagtaggtactttgtaagtatcgacagttagtattctgagttggagttgtccagccctcaaagaatcctgacagatgggctacattctcagaactagaaggaacctcaaaagatttcctaggccgctggtttccaaactcttttcttggagaactagggattttgtagaggtcctcggtggatgaagggacactgagcatgtggagctccttcagccagggcagcgggttcaaatgtgagttacatgccagttgcatgcatctggttcttttagttattgggagatgaggtatgatttcatttgacaaaaatggtcccactgctcttcttaa

SEQ ID NO: 404258 - DNA, 784 bp, Homo sapiens
agcggatgttctaaagggatgtcatcatttacaaaatgtctttgttgagtctgaatggttcaaacaatagcaaaaaaggattatttctctcttggacatttcaaagtactatgacacaaaatatccaagacttgttatggtgaggagccaagtggaatggaaaggacagctcatcccggcggctgggagtgcatgcacacacatgccccctttttcttgcctactaacaggatctatagaaggcgtacataatgaagcaagagatggaccctgagggtacttgaagccaacaagtttcacttctggaaaaagacttcagaatatgagtttaaaatataaaaagggaatttgagccaagacacaagaacaaactttttttgacaattatatctttattattcctcttacagagctacatttactcttactaagtttcagagtcaggtagtaatttacagtaagactgaattaccatccataacgttagatgtccttattgaaacttcaacatcatttccaaatatcagcattagcattgtgcttgacattcatttaacgaagttactgaaaatctattaagtataagacatcagttatttttaatagaagtttctgaaaacatttcagcaaaatagcctgttgagaaaaatgtgtatgctgaaaaaaaaaatgaacaaataggaaagcctggttcacaaacaggtgtcagggaaatagacagtacttttatagtaataacataagaacaaacttcttgaaggtaagttttattaaataataggac

SEQ ID NO: 404259 - DNA, 579 bp, Homo sapiens
agcggatgttctaaagggatgtcatcatttacaaaatgtctttgttgagtctgaatggttcaaacaatagcaaaaaaggattatttctctcttggacatttcaaagtactatgacacaaaatatccaagacttgttatggtgaggagccaagtggaatggaaaggacagctcatcccggcggctgggagtgcatgcacacacatgccccctttttcttgcctactaacaggatctatagaaggcgtacataatgaagcaagttgcaagacaagtccaaattcaagaaggtcaagaaatacactccatctccagagaaatctatgactttgagttgaaatatctgaggccaacactccaagcaattttaaacaagtggtgacagaaattaccagacacacatcaagactcaagtataaagctatacaatttaaggatgctcagcaaatgttactgaattgactgggtagtccctaaagagctgaagaataaaagatgttatgagaaatccaacaataccaaatataaattgcctcaggttctgaaatattcaataaagtattctcactgtaaatccttca

SEQ ID NO: 404260 - DNA, 522 bp, Homo sapiens
ccaaaatatcagattcagtcctatgtaatctggtttccattgcattctcttggccagagcaagttgcaagacaagtccaaattcaagaaggtcaagaaatacactccatctccaggtaggagaagctgcaaagaactgtgacaatctatgacaaatagtatgttcaaagggaataatatgggaagatgtgccctccgccaacttctcagggaaaaatacagcttttgtaatatttagtaatatagactgtctaatatttctagagaaatctatgactttgagttgaaatatctgaggccaacactccaagcaattttaaacaagtggtgacagaaattaccagacacacatcaagactcaagtataaagctatacaatttaaggatgctcagcaaatgttactgaattgactgggtagtccctaaagagctgaagaataaaagatgttatgagaaatccaacaataccaaatataaattgcctcaggttctgaaatattcaataaagtattctcactgtaaa

SEQ ID NO: 404261 - DNA, 555 bp, Homo sapiens
ctagaggtggcagagaggggtggccagcacagctccagccagcagctcccacactgctcccagtcctgggcacagtggaagctatggaggcagagaccagggtttgcaatctgggctcctctgcctcactggagagggacttctcccattcagcagagcagcagccctgctgctgaagggcctgctgctactgctgctggggctgtttgcctgcctgcaggaggtgctggagagcaagaaaaggagcctgtgagcaggggttccagcaggtcctcctgctcccagaggcgacctcctcctccaggcatggaggtttgccctcagctgggcatctgggccatttgcccctaatgtgctgcccaggatggcctcttcttgacaggcggacagggggtgagggggccagggggcatctccaaaggaagcttttaaactcagcagctgcaccccagaatctgtatgcctgcacctgcccaaggatttattcatagcttacctaagaatttcaaatttctaccataacactgaaataaagtttgactttttgaaacttca

SEQ ID NO: 404262 - DNA, 256 bp, Homo sapiens
ctctctccaactggctctccgacgtctcggacgaagttgcaaagaacttcctctccggcagcgcggggtcctggcgggtttggagatgcttccgcccctgacgctggggccgcgactccggagtccccgggagcgtgcagccctccaacactgagacccgctgccttcaaagttcccgcggcccccgctgctcgcccatcgctgggaccaggaacggggacaccagcgacggactcttcctcgccggggtgtctac

SEQ ID NO: 404263 - DNA, 895 bp, Homo sapiens
agctagggtctcattctgtcacccaggctgaagtgcagtggcacaatcatggctcactgcagccttcacctcctgagctcaagcaatccacccacctcagcctcctgagtagctgggactacaggcacgtgccagcacacctggctaattttaaaatttttttgtagagaggaggtctcaccatgttgcccaggccagcctcgaactcctgggctcaagtgattcttccacctcagcctcccaaagcactgggatcacaggcatgaactactgcccctggcttcttggcattctttacctttgaaataatacgcaaaatattctgtgttctctgtgtgtattcttctggggagataactttcttcatcactttattaaaggagtctgtgtctcaaaaaggttaagagccaggagactagactagtagcagatgctgggagaaatggagagctaaggaaaatgaaggaactgagacagatagaaggggaaagatccgaggagaaagaaagactaaaaggaagataaataaacaaaaaagagagaagaagaatttcattgctagacatgaaattttagttataaaatcatataataaaaattggtggccaggcgtggtggctcacgcctgtaatcccagcactgtgggaggccgaggtgggtggatcacgaggtcaggagttcaagaccagcctgaccaacatgctgaaaccctgtctctactaaaaatacaaaaaaaattagccaggcatggtggcgcacgcctgtagtcccagctactcaggagactgaggcaggagaatccacttgaacttgggaggcagaggctgcagtgagccaagatcatgccactgccaagatcacaccagcctgggcaacaaagcaagactccgtctca

SEQ ID NO: 404264 - DNA, 482 bp, Homo sapiens
ctggggagaggggagaaactgctcccagtggagaaccacttaagtagagaaaggcttcagcaaatccagatgttctggcaaagatgggaaccaggttcctcggactcagaagactgttggtctccacaaggcaagagtgccctctggtggccagagtcagtaccggcggtcgagaggagctcagagccccggcctaggctgggtgcagagcccacagccgactctgaggtgaaggggtgatgcccaccttggaatcctctgagaggaggaagagagttgcagaataaaagcattttgtgagaaccttcccatttcaaacccccttagcaaatcatggactatccaccaaaggcgtacaggtctaacgtagcaacacactctgcagcctgtttgtttctggtgcaaccaggtgacagcacatcctctggccatctgtgactgtgactgtcagcctcatctggggatagaatgctgtggatgct

SEQ ID NO: 404265 - DNA, 361 bp, Homo sapiens
ttcagtgcttctagcagtcagagagtcagtggtttcttttctctatgaagaaccatgaactaattctgagaaggtgaacttaaagagagcagaaacctttaaaaaaaaaaagttttaactaattcataaaggtctttcttctgatgatcagagtgctagaatacagattgggtatttggagaagagatggaatatatttttttttaagttgatgctttttctagaactgttggatattgacagaaattcctctaagctctactagctacccaaaagatgttggtgtcctgaaaggtatggaaaatagagttatggtcatgtagggttttaaaagaactaaaagaggctttaaaagtccaaa

SEQ ID NO: 404266 - DNA, 474 bp, Homo sapiens
atctgtggaaacacatgtattcagagcaactttttttggcctgaagtcactgcagtggaacatttgggagcaagtttccccagggcccagctccttcccgctaggctctgccatgcctcctgtttattaacagggaggcgtgacaaagggaaaaatctcctgattgaagactcatctcagacatcttttcactcctctagggaagggtgcaattctgggctttaatgacatatgacggggcaggcagtagaggtgttgcgcattttaggcaatacatgtgctgctagaaagttgaggtatagggactttttaggaacacaatttttattgacaagtaacctttcaagaacaataaagaaaatcagaaagaaaacctatgttcatagcagcatcattcataatagcgaaaacaactcaaatggccatcaactgacgaacgtatgaataaaatgtggtctattcatgtgatggaat

SEQ ID NO: 404267 - DNA, 225 bp, Homo sapiens
aattctactagactttcaaagaagaattaataccaatctgttggactctattccacaagataatgaaagaaggaaccctctctaactcattctatgaagccagcatcaccctaataccaaaatcaggaaaggacacaaccaaaaaagaaaactacacaccaatatccttgatgaacatagatgctaaaatccttaagagaatactagttaactgaatccaacaaa

SEQ ID NO: 404268 - DNA, 509 bp, Homo sapiens
tttgtttcattttcccaaggagaatacagaggacagtacttaagttttagttatgttgattgcttgtgtgaaatgctgattcctgccagcagtcgccaggtgtctctcacgctgctgggagaggaatgtctcgtcttcttcatctggttgcctccgtcactgttctagaggcttctggcactggtgcaaggcagagctgtgcttccttgagagtgtgccaagcatttactttggttatttagttctagtctgggagcagacacaaaaggaaaaaaaagaaaataccaactccatgtgtctgaggtatcacttatagtttaaaaaaaatgattgtcttatcatgtttgggaaaatactggtcttcctgttttcctcctatttaaattcatcctaaaacttccagggacacaagaaattattagctattttgaccatccattccagaaaagatggtggccttacaatcaattgcaagtggttaatagaaacatccttttacagcttctatt

SEQ ID NO: 404269 - DNA, 328 bp, Homo sapiens
agatataatggaaggcatgagctagatcaattctacaagtgaaaaattacattaattaagaggaaggatcactcatcacccaattataggtaagtttataggagggtgggactggctacataatggtaggtgatactttatgtccttattttcattaaagagaatatgtcatttcctgaaaatgaaagatgtgggtttgaatagagagttggcaaaatttggtatttatttgaaattggcatttatttgggaagataatgtagggtaaccaatccacttagatgatagttattaactataaactatgtaccaggtactttgctataat

SEQ ID NO: 404270 - DNA, 363 bp, Homo sapiens
cttgactaatactggaaagtaatcaaagtctacacacatacacacatacatataaacacatatatatgtatatataactgtacatttgcatagggctttataatttcatagatactttgtcagttgaccctcacagtaatcttggggaataagaagcacaaaaaagtattttcaaccccgttgtaaagatgaagaaaagaatgatcagatgacttgctcaaaataaaaatgacttgctcaaaattacacagataagcaagaggcagaatcaactgacactcgtgtcttctaacttgtacttcagggatctttgtgctacactaggttaactcaaatttagtttgaataaaaaattcaatatcc

SEQ ID NO: 404271 - DNA, 379 bp, Homo sapiens
catctttgatgggttgagagtactaattgtatcctagacttgctcatccccaacactgaggccctgagtctgtaccctgacttgggggctgaactggagcaactctttgctctgggagaagagttaaaaggagttcacaatgttcaggcccagctgtcttttgggagagatgtctgcactgattatggatccaaacatcagagaggaagtgacaacttttcagaatccttgattcgaagtcaagaaagcctagaagaacatgcaagacaacattcaagcagaacccagggatactatgcagaaagtctttcaatttgaatactttacttatttctttactcatgtgtgtatttattgaataaataggtattaagggctt

SEQ ID NO: 404272 - DNA, 504 bp, Homo sapiens
tgtgtgtttccagtctatttttatgagttcccatcataagtcacaccatccatcatagcataagcatttgaccctcattatgagacatcaagaaagctgtcaccattgccctagcaccagtgtctccagtaaatattggaaatgttaggagatctcatttagtaaattcctgagtgttgcctgccagcgcattgggtcttagtgttttatgaattattctttagtctatgtacttttatcacacttgacagttatcataaatggtctttaggctgaatactagtttttaacaaaggaaaatactcaacattattaagaaggacctgcctggatctgctatagggatgcagaatatagaaattaaaaatatttgagatcgatgtctgtgcaacatatgaaatcatgtaaacagatacaatcaataatttctcttcagttctaacagagccccataaaaacgatttggttcagtttgggctacctgggatggctaaaaaataaaaa

SEQ ID NO: 404273 - DNA, 745 bp, Homo sapiens
tcctattgtctggtacaacttgggggtgaagacaggctttcatctcgtgttacccggaagggccctcaagctgagacacagggccgatatacagaagcagctaattgtgatccttgtggggctctttcatggccagtgtgtggacactatcgtcccctggttttgggagttttcaggcaatcatctgtgtctctggaagatggcataatccctacaccatcttccctgattaagaactatgcttctccagtttttttcccccagatgacaccagagagggagtttggggtctggggacctgtctgtcccaggctggccctgcacaatagcgtggtgagtctgagtggtgggcacaccatgggagggctgttggctattgggatcagtgatctattttctagagacaacttatgcccaaaacagctttgctctgcacagggtgctggagtgagaggctaccagagctgctctccactgtgcaggcctagtgtgagttacattaggaatttgcagaccatctagatgttatttatttttagagacagggtccaggcggtttcaaactcctgggctcaagcactcctcctgctttggcctccctagtagctggaactacatgcacacatgccacgagacctggaaggttttatttttaaaacgttgatggttacttgggtatatattaatatacctgggtatgtttctgtgatgttttgctctccaggtttactttgttaaatgtatc

SEQ ID NO: 404274 - DNA, 351 bp, Homo sapiens
acagagtcattattgtgggttatttgagtgggccctaaaggcaatcacaaatttccttacaagagggaggtagagagacacaaaaaaacagaaggtggtgggaccatggaaggagagtgatttgaagatgctatgctgctggctttgaagatgcaggatgtggccaagagccaaagaatgcaaggaatgtagctctagatactggaaaaggcaaggaaatggattctcctctagagcctctcaagggagcacggccatgggacaccttggttttgacctagtgaaacccacttcagacatctgacctccagaactgtaagaaaataaacctgtattatgtgaaaacaccaa

SEQ ID NO: 404275 - DNA, 168 bp, Homo sapiens
tgcagattacgatcaatgcaagataaaacctgagctggccaacgcttagcttttcatttaaagcctttggccgcaaaaccagttgttcctgagccttttacccccaagtaaaaaatttagctttctttgcaaaatgttgtgtgcttggtaaacactagaatgctattt

SEQ ID NO: 404276 - DNA, 140 bp, Homo sapiens
atgtattgtggtatttagaaaagggattggtggtgactgggccaccagcattggttaagcaaactaagtcgttccaaaacaaccccatttccattttttatggtgatacaagattgataaatcagaagactataatagat

SEQ ID NO: 404277 - DNA, 388 bp, Homo sapiens
ggtggtgggtgggaaataaatacccctgcctctctctcctctcaccctttgatcttctgatcttttgattactcccatttgatgaacctcagggcaaaggaatatgacttaaccaatccgtaaaggtcagtccctccgccagccccttccccagatgcacagaacaagatgcaaaatgatagacaatggatccgaatgaaaatattcactgtagaactatctatttacagaactaggaataaactaaaaatgataaaaaccaaaatcatcttaggataactttttaaccaggcattatactttttaaaggcaagacctttatcttcatctctgacttacagtactaggcacatgcaagagaggctcatcagtgctgtgtgtggaaact

SEQ ID NO: 404278 - DNA, 665 bp, Homo sapiens
cccccaaaggcagcttcaggtaccaaagaggaccttaatttagcccccctccttcaccagcagtgggcagcatctgtgaagagaatagtgccatcatctggttttggctggacaaaggtgagccccggtgatgccctgactggaaactattacaagctgccccaccagtgggcccactgagcccctgcactaagttactcaaaatgtgctaaaaagtttcttctttttaataaaaactagccattgcattggctccttcttccaaaaactaaaaataaaaagactttgctttgtggttggagctataaaagaattgataaccccgatactaaagtatacaaccaagaaaagtgtcaaatatatagttgatttagaacctggattatgttgaagaatttttggtgttctgagggctatgtaaaaatcttgtagactatgggtgctccagtcactaggcagataagcatttattatacatgatttgtaaaataaggcatttataatgttaaatatttctaacaattctagagaatgtacctttcaaaaaaatggaaacttagaaacatatatcccttgtcattttctttcactttgaatctattaatagattcttacaaaacaaaaagtttaataaaaattttctcactcagatattttggaattgt

SEQ ID NO: 404279 - DNA, 374 bp, Homo sapiens
ctatttccatcctccagcaataattcatatagtaatgatttggtggctgatatggtttgactctgtgtccccatgcaaatctcatcttgaattgtaatccccacatgttgggggaggagcctggtaagaggtgattgaatcatggggtgaacttcccccttgctgttctcataatagtgagtgagttcttatgagagctagttgtttgaaggtgtgtggcacttcccccttctcgctctctctcctgctccgccatggtaaagatgtgcttgcttcccctttgccttctgccatgattgtaagtttcctgaggcttaaccatgcttcctgtgaagcctgcagaactgtaagtcaattaaacctcttttcttcat

SEQ ID NO: 404280 - DNA, 370 bp, Homo sapiens
taattttatttcacagaatgaatttcaaaaaccagatgagttttgctgggtgtttcaagatggccaaacaggaacagctccagtctacagctcccagcgtgatcaatgcagaagaaaggtgatttctgcatttccaactggggtacttggttcatctcattgggactggttggacagtgggtgcagcccacaaaggattatcctcgatacttggataatgtccatatatggtgctgattttggccatgtaactttattttatgttatggtgagtagattaaatctctgaaattttaggctttgtcatgtcacttgctttaatcaaataaatatttactggtgtgacacaagcaaacacctgaagcttact

SEQ ID NO: 404281 - DNA, 1366 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccaaaaaaaaaaaaaaggggcggccgccctttttttttttttggtttggggacgtttttatttcgcaggctactttagacttcttttccctcattgtttttgttactatacgacccctgtgctattggggtttaacgggcctggcgcg

SEQ ID NO: 404282 - DNA, 1170 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404283 - DNA, 829 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtaagagtaccccatggatgggaggaaaccactctccaaggggtctaccactcatttgctgtgtggccttgggcacatgagttcc

SEQ ID NO: 404284 - DNA, 933 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagtatgtgatttgtattaagaaaaccatggggtttcccccttcattttgtaaatatgaaagttatccctgtaatggtaaatacactttttcatactgtcccgtgtctcttactcctcatccctgaggagtattgattggcccccctcttctcggcccccagtcactgctataaagtatttgaatacttaccttgggctcagccaggttcttatctttatgctagttgggagtaaatatgtgctttgtttctttaatttgtttgtaagtaccagccttttgatattgtaatccttccagcctagtgaaatacctggctgttttcttttgtgtgggtgggggcattacttgaactctgaatctcttcatcctgtgatggaagaattcaatgagtctttgccagtaaagtatctagtgcagggcttggcataatctagttttccataaatattattagtttttgatgattaacttatgggaataattaaaatttgcatgatacagagaatagttg

SEQ ID NO: 404285 - DNA, 1315 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccaaaaaaaaaaaaaaggggcggccgccctttttttttttttggtttggggacgtttttatttcgcaggctactttagacttcttttccctcattgtttttgttactatacgacccctgtgctattggggtttaacgggcctggcgcg

SEQ ID NO: 404286 - DNA, 1279 bp, Homo sapiens
gatggagtttttttagaagcaaggagtattaattttatttaacaaacacatatagagccctcactatgtgccagatattattctaaacactttacaactacggattcatttcattatcattaaaatcctgtaagcgatgagcaccatgatgatccccagtttgcaaataagcacactgctcagagaagtgaagggtcacacggctggtgagtggtggagccaggatttgaatgcaaggaatctgtcaatgtctctgctgtttgtgctgttagagaaaagctccacctgcacagggagaagcctgatgacagggcctggtggtctctgtatccctgggcctggaccttagcagacctcagttagtagtcactgagatgaaatggaatggaagatgagtagtagagtgcctgtcaggcgttgtgatgatgacagggcctgtggacccactgtgtccttgtgcccactgcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404287 - DNA, 1221 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404288 - DNA, 1036 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404289 - DNA, 975 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404290 - DNA, 1283 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404291 - DNA, 1028 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaaggtgagagacctggaggctccatggcagacttttcaaaatgcagctgctatctgtttgtgggtcatagaatcctttagtgggtcttgaccagcatttttaaaatacagattagaaaagaagatactggagtgaataatatgtatgtattaagggcaagaatccttttgtgaaacttgaggtttagtcatgtgtgtttctggtgtgtgtctgtactgggtcatggtataaaatgaagggcttggccgggtgcagtggcgcatacctataatcccagcactttgggaagccaaggcaggaggaccgcctgagaccaggagtttgataccagcctcgccaacatagcaagactccatctctaatttaaaaataaggctggggctgggtgtgggggctcatacctataataacaccttgggaagcccaagtgggaggatcacccgct

SEQ ID NO: 404292 - DNA, 1137 bp, Homo sapiens
gatggagtttttttagaagcaaggagtattaattttatttaacaaacacatatagagccctcactatgtgccagatattattctaaacactttacaactacggattcatttcattatcattaaaatcctgtaagcgatgagcaccatgatgatccccagtttgcaaataagcacactgctcagagaagtgaagggtcacacggctggtgagtggtggagccaggatttgaatgcaaggaatctgtcaatgtctctgctgtttgtgctgttagagaaaagctccacctgcacagggagaagcctgatgacagggcctggtggtctctgtatccctgggcctggaccttagcagacctcagttagtagtcactgagatgaaatggaatggaagatgagtagtagagtgcctgtcaggcgttgtgatgatgacagggcctgtggacccactgtgtccttgtgcccactgcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaaggtgagagacctggaggctccatggcagacttttcaaaatgcagctgctatctgtttgtgggtcatagaatcctttagtgggtcttgaccagcatttttaaaatacagattagaaaagaagatactggagtgaataatatgtatgtattaagggcaagaatccttttgtgaaacttgaggtttagtcatgtgtgtttctggtgtgtgtctgtactgggtcatggtataaaatgaagggcttggccgggtgcagtggcgcatacctataatcccagcactttgggaagccaaggcaggaggaccgcctgagaccaggagtttgataccagcctcgccaacatagcaagactccatctctaatttaaaaataaggctggggctgggtgtgggggctcatacctataataacaccttgggaagcccaagtgggaggatcacccgct

SEQ ID NO: 404293 - DNA, 1777 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgataccactggcgagtggctggcttttaattcccctgggccagacctgcagccttgccttcatcccttaactccaggactccaggggcagagtccctggccttcagccaagaggccttgccagcttgggggcccaccaacaagggaacattgccccaacctgtgccacagccccccggctgtttataggctggagaggctgtgtcagacttccctgtactacacaagggcaaccccagccaaagctcaccctgagcctagctcaacagaagtttccttgatctgcttcacattctcttttggaacttctaggggctcccagcaccctctgcagcctcccagctattctgttctcatcaggtccttcccctgccttctggggcaacccctctcctcacagtggccttaaatctaggcaagggttagtccagcacctccttgatgagcaattctttgagactggggggtggtgtgggggtaaggcctgcctcctgcagggcttggagccgagcctctgattgacgtttgtccaggcccaggcgccaggagagccggacatgggcctccagaaagggtgccagcaaagggtggaggctcttgtccccaagcagctgc

SEQ ID NO: 404294 - DNA, 658 bp, Homo sapiens
cacccatgcacgggagtcccttttccccctacctccgtgcaggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtgagtgtggggccgtgtgggacaagggcactgaccttgagtggcaggagcctgctttcttgggtgatgctgatttcccgacttcctgtgtggcgctgcacaggtcacttcctttccttccctcccaggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatca

SEQ ID NO: 404295 - DNA, 1441 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggtagccggcagctcctgcccagcatcccctcctttagggcagaaacttgatcttgactgccgccgcccggggcccctggctccgggactagtatggctctgcgtgggatgcaccctctgccacgattaggagagaactcgcccccaacagagctgtcctctctgctctggcttcctcccttcctctccgcgctgcgaggtctgcacagctgagcaaatatagtggtgacctgagagaccctgctcggcagcctgccctaagccttcacgggggagctagcccagagagggcagtgatttgcccaagggcacacagctgatggatcagccttaaaaccgacgccgcagctccttgtgtcttcagtatccttttcttctcacaatatcccgcccccagtaccatttggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404296 - DNA, 1232 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcagagcagatgccctcatgtgttctgcgtagatccccagctgagaagagtttgtggacctttacagggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404297 - DNA, 1360 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcagaggaaggcattactgggtaccggccaagaggctgtttggtggtcagatcgtgggccaggccctggtggctgcagccaagtctgtgagtgaagacgtccacgtgcactccctgcactgctactttgttcgggcaggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtgagtgtggggccgtgtgggacaagggcactgaccttgagtggcaggagcctgctttcttgggtgatgctgatttcccgacttcctgtgtggcgctgcacaggtcacttcctttccttccctcccaggctttggcatcttcatcttcaaaatgagagggtgaggccgggacacctgctctgctctaaatttctagaatgtgctggaaatgtgattcaccttctcccagggacccagttctagtcccaaaaccagttcagattctttgtattacaataggcaaatcatatcttccatctgaacctcagtttcctcatctaaacaaagagggttacattacagcagtggtatccaaacccgcagtccatca

SEQ ID NO: 404298 - DNA, 1492 bp, Homo sapiens
ttccggttactagggcaatctgccggaagagtcaggttctgtgtatgtctccgcgtcttccgcggagcgggtgtgcagggcctgcagcattgaactagatgtcgtccccgcaggccccagaagatgggcagggctgtggcgaccgcggcgatccccctggggacctccgtagcgtcttggtcacgaccgtgctcaacctcgagccgctggacgaggatctcttcaggtagccggcagctcctgcccagcatcccctcctttagggcagaaacttgatcttgactgccgccgcccggggcccctggctccgggactagtatggctctgcgtgggatgcaccctctgccacgattaggagagaactcgcccccaacagagctgtcctctctgctctggcttcctcccttcctctccgcgctgcgaggtctgcacagctgagcaaatatagtggtgacctgagagaccctgctcggcagcctgccctaagccttcacgggggagctagcccagagagggcagtgatttgcccaagggcacacagctgatggatcagccttaaaaccgacgccgcagctccttgtgtcttcagtatccttttcttctcacaatatcccgcccccagtaccatttggggacccgaagctgccagtactgtaccaagtggagcggacacgaacagggtcgagcttctcggtgcgctctgtgaaggccgtgcaacatgggaagcccatcttcatctgccaggcctccttccagcaggcccagcccagccccatgcagcaccagttctccatgcccactgtgccaccaccagaagagctgcttgactgtgagaccctcattgaccagtatttaagggaccctaacctccaaaagaggtacccattggcgctcaaccgaattgctgctcaggaggtccccattgagatcaagccagtaaacccatcccccctgagccagctgcagagaatggagcccaaacagatgttctgggtgcgagcccggggctatattggtcctgagctggaaagcccaggagcccagggctgatggggacctgttgcaggcgagggcgacatgaagatgcactgctgcgtggccgcctatatctccgactatgccttcttgggcactgcactgctgcctcaccagtggcagcacaaggtgcacttcatggtctcactggaccattccatgtggttccacgcccccttccgagctgaccactggatgctctatgaatgcgagagcccctgggccggtggctctcgggggctggtccatgggcggctgtggcgtcaggatggagtcctagctgtgacctgtgcccaggagggcgtgatccgagtgaagccccaggtctcagagagcaagctgtagccagaggtaccagcttcgcctggggcttcaagaacctcccatctatccccattcctgagacaggagttacagtcccttttggccctcacatccaataaagagactgatacca

SEQ ID NO: 404299 - DNA, 535 bp, Homo sapiens
ttgtctaccttgctgatttctctggtatacagggaaaataagccattgaaaacagtttgatacaagttgctgtgctaagatagcagatttgtttgagaggctgcgtagaccacctctattcagcctagtctcccccagtctatgttaaaagataaatatgcagctaatttagttcagcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttactttttgtcaaaatgtttttaataaaagtgttaaataacaaaaaaa

SEQ ID NO: 404300 - DNA, 275 bp, Homo sapiens
gcggaagtgcattgatccctcagcccgtggagaaagagcggaggcgctgtgcggttttccgtgggggtgtcagctccggcccgtgccggaagaaggagccaagaccgggatcgcttttttgccccttcctcaccccacattcggtcacgaagaggtggaaacaaaaggacacttacaatgtagtccaacctcctgattttacatatgaggggattgttccacggaagttaaacaatttgccagacgtcattatgtatctactgagtgagagaatc

SEQ ID NO: 404301 - DNA, 463 bp, Homo sapiens
ctataggaactgtggcataaggaatcttgttctaagctactgtcttttggtgtcatttgttatccagccatggataactgatagacttcttcatccacatctgctacctgtagtcaaccaaagcagttttatacaaaggtactattttctggctttttattccaaccagatttcacaatttttttgagtgtgggtgtagaggatggtgaaatatccatggaatagaagattgttgaataagaaagtcagaggtagcaaggaaaatgtgtatttagttcaaaaaaatcctatcaacctagttgtatgtgttgataataaagatctctctgtctttcccagcaattcggatcaaccttgttaaggttgaacagagacagacccaggtgtttgaatggttcatatttgtgttttactcctaagggtgaagcacctgtaatttttagggcttaagatatcatcaaga

SEQ ID NO: 404302 - DNA, 468 bp, Homo sapiens
cacccttgagtgaaccaggtacaagcagcctccacccaggcattttcttaatgtccacaaaggctcgctgacttcaagttagctatttgtgtcctttaacttgttgccacaatttaaaaccaggtgagcattttctgcacagagtggtcataagcagtgtctgttctgctgtgctcggcctctttgtcacctgttccatatttgggcatgaagcactaggcccatatgccttcaccattttgcaatgttgttctgggacagagttatagggtttttgccttgaacaaagcatctacattcttcattcttagggagtgacagttccattgccaatatgtggatatcagttttcttcaagcttgtgtaccactcgtatccactgctgttcagttgcataatctctaagattaaaaactacattttggtaatgctggcaacgagggcacaaggaaataaattgtctgtttt

SEQ ID NO: 404303 - DNA, 422 bp, Homo sapiens
aaaaaaaaaaaaaaaaaaaaaaaacaattaggaaagggtaggtatgagtaaaacaggtgaaaggtggggaaagtgtgccaaatgggaagacaggctctcaatgtagtccatagtttgacttgtggcttggctttctggctttaaactgaaaaagcctggaggttttggcttggagttggggtttcactggggacctgcccctatctgcctaggcgtttgtctgcctcttgctgctatcacatagattgtggagaaatcacataataataaagttaagagaagatataatcagagaaacaagctgcaatgtattttaccacctccaacaaaaattacctgctaaaagtggccgggcacagtggctcaggcctgtaatcccagcactttgggaggcaaaggcaggtatcacttgaggtcaggag

SEQ ID NO: 404304 - DNA, 2263 bp, Homo sapiens
cggggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtc

SEQ ID NO: 404305 - DNA, 2985 bp, Homo sapiens
cggggacaccacgccagtgctttcctgccttccttccgagatggaaagaggagctcctagctcacttaagccggggtagggctggttctcctttccgagccaaaatcccaggcgatggtgaattatgaacgtgccacaccatgaagctcttgtggcaggtaactgtgcaccaccacacctggaatgccatcctgctcccgttcgtctacctcacggcgcaagtgtggattctgtgtgcagccatcgctgctgccgcctcagccgggccccagaactgcccctccgtctgctcgtgcagtaaccagttcagcaaggtggtgtgcacgcgccggggcctctccgaggtcccgcagggtattccctcgaacacccggtacctcaacctcatggagaacaacatccagatgatccaggccgacaccttccgccacctccaccacctggaggtcctgcagttgggcaggaactccatccggcagattgaggtgggggccttcaacggcctggccagcctcaacaccctggagctgttcgacaactggctgacagtcatccctagcggggcctttgaatacctgtccaagctgcgggagctctggcttcgcaacaaccccatcgaaagcatcccctcttacgccttcaaccgggtgccctccctcatgcgcctggacttgggggagctcaagaagctggagtatatctctgagggagcttttgaggggctgttcaacctcaagtatctgaacttgggcatgtgcaacattaaagacatgcccaatctcacccccctggtggggctggaggagctggagatgtcagggaaccacttccctgagatcaggcctggctccttccatggcctgagctccctcaagaagctctgggtcatgaactcacaggtcagcctgattgagcggaatgcttttgacgggctggcttcacttgtggaactcaacttggcccacaataacctctcttctttgccccatgacctctttaccccgctgaggtacctggtggagttgcatctacaccacaacccttggaactgtgattgtgacattctgtggctagcctggtggcttcgagagtatatacccaccaattccacctgctgtggccgctgtcatgctcccatgcacatgcgaggccgctacctcgtggaggtggaccaggcctccttccagtgctctgcccccttcatcatggacgcacctcgagacctcaacatttctgagggtcggatggcagaacttaagtgtcggactccccctatgtcctccgtgaagtggttgctgcccaatgggacagtgctcagccacgcctcccgccacccaaggatctctgtcctcaacgacggcaccttgaacttttcccacgtgctgctttcagacactggggtgtacacatgcatggtgaccaatgttgcaggcaactccaacgcctcggcctacctcaatgtgagcacggctgagcttaacacctccaactacagcttcttcaccacagtaacagtggagaccacggagatctcgcctgaggacacaacgcgaaagtacaagcctgttcctaccacgtccactggttaccagccggcatataccacctctaccacggtgctcattcagactacccgtgtgcccaagcaggtggcagtacccgcgacagacaccactgacaagatgcagaccagcctggatgaagtcatgaagaccaccaagatcatcattggctgctttgtggcagtgactctgctagctgccgccatgttgattgtcttctataaacttcgtaagcggcaccagcagcggagtacagtcacagccgcccggactgttgagataatccaggtggacgaagacatcccagcagcaacatccgcagcagcaacagcagctccgtccggtgtatcaggtgagggggcagtagtgctgcccacaattcatgaccatattaactacaacacctacaaaccagcacatggggcccactggacagaaaacagcctggggaactctctgcaccccacagtcaccactatctctgaaccttatataattcagacccataccaaggacaaggtacaggaaactcaaatatgactcccctcccccaaaaaacttataaaatgcaatagaatgcacacaaagacagcaacttttgtacagagtggggagagactttttcttgtatatgcttatatattaagtctatgggctggttaaaaaaaacagattatattaaaatttaaagacaaaaagtcaaaacaaaaatattttctaacttgtaagttctatttaaagggggtgggggggaatcttgggaacgttgtggggtacaagccacaagttaacttgctatgctgccagaagggatttctggtataaggttgaaattgctgagataaaataaactaaaacaacaaacatccttaaagaggtagggtgtgggctgctgagggggcaagagggatagactgaatctgtcattttttagaagatgcttcataggacacaggactatccatttctacagacatctttcttaagccgagagctgtctttgcagaattatcttattaaaaaaaaatacaaaaaaaaagcaccatgaatttgtactgtgccaaaatgatagtggcaataatatttttcttcagaggctaaggggaagatagacctgtacatgtattttaagcaggaaaaccaccaaaattcaaacgaacccttaaaggggctgagtctttgtccatgtgcacaagtcttgggggtctgtgcactggacacacatgtgccttgcctgacagaattgcttagaaaggagcagagaaggacgggagctggcgtagctctcagtctaatgctttcacattgcaccagattcctgcagttgggcttaacccactctgcaaggcatgtgtctattcagggtttcccaggaggaggaggcccctgaaggggtgcggcagcaggggggtgggaagggagg

SEQ ID NO: 404306 - DNA, 664 bp, Homo sapiens
tgaacgatactgagctcattcgctacgttaccatcaccaactgcagtccgttggttgtgaagtttcgctggttcttcttggtgaatgatgaggaaaatcagataaggtacccccagcacagaactctcacagaactctgcttttcatttgttttctctttcaggcttttcatggggttttctgtattccatgtactggccattcatgaatattttccattttgaccactaattattgacagaattaacaaggagcttaaaatcacgatccatcctcgatttcctaacaggaaacatagataaaacatctttgaaagtcccaatcaccaccgaattaacaaagcaatatccataagcccactttatttttgagtctagtgataagaccattagaaattcatcactaaaaaataaagtctttgtagaattgtttaaattattattttattgtggtaatatatatacaacttaacaaatttttaagtgtacaatacagtattattgactataagtaaaccagatttctagaacttatcttgctgcactgaaactttatgcctgttgcccattctcctttctccccagcccccgcaaccaccattctactctttgattttattaatttaactattttaactacctcatataagtggaatcatgcagta

SEQ ID NO: 404307 - DNA, 452 bp, Homo sapiens
tgaacgatactgagctcattcgctacgttaccatcaccaactgcagtccgttggttgtgaagtttcgctggttcttcttggtgaatgatgaggaaaatcagataaggtacccccagcacagaactctcacagaactctgcttttcatttgttttctctttcaggcttttcatggggttttctgtattccatgtactggccattcatgaatattttccattttgaccactaattattgacagaattaacaaggagcttaaaatcacgatccatcctcgatttcctaacaggaaacatagataaaacatctttgaaagtcccaatcaccaccgaattaacaaagcaatatccataagcccactttatttttgagtctagtgataagaccacaataaaataataatttaaacaattctacaaagactttattgtggtaatatatatacaacttaa

SEQ ID NO: 404308 - DNA, 310 bp, Homo sapiens
aaaaatcaaaatccgcctcagaaaaaagcaaaacacatggcacttacattctgccaacattcctactgccttatactttttcagtctgcactcttgacattttctacgcatgtacatgtccatttcacagtgactaccattcctgcaactatatactgcattttgttgatgctacattgaaaaaaacccaataaaaaagttttaaaattttttaccataggtatttctagttaattatttttattaatatatgccttcatattaatcacgttaactaaattatttcaataaaatgttttttctctcaata

SEQ ID NO: 404309 - DNA, 482 bp, Homo sapiens
aataggtgggaaattctgcttttcattcagactttcatttagaattttaagtaatagagtcaggattatgctatgttgcttgggttgctctctaattgtttgtctcaagcagtcctcccagctcagcctcccaaagtgctgggattcgaggcatgagccaccatgcccagacaaggtttgtctccttataaagaattattcattgctgggcacagtggctcacatctgtaatcccaacaatttgggaggccaaggcaggaggatcacttgagcccaggagctcaagaccagccacagcaacatgacgattccctctctctacaaaaaatacaaaaaattagctggatgtggtggcacataccatatccaggaggctgaggcagaaggagaaccaaagcctgggaggttgatgctgcagtgagctgtgattgtgcccctgcactccagcctgggtaattgagtgagggcctttgttaaaaaac

SEQ ID NO: 404310 - DNA, 475 bp, Homo sapiens
ttttactgttttttcatgagaattgaagcagggaaatatttggctaggcaatgttacaaaagaaaaccagtcgttgggttattgttggagcagaaattccctgaagtcccataggaagccttccacaattgggccatgcagcaggatcactacgagagccctgtcaaaatgcactttcatcatttctacctgccactcctgcagaagtgtcgaattaacgtccagaggtggggcttgagcacctgtgacttccccaggctcccttttgggcagccctgacccatccttccaggtgctgggggtccctgcacacaaccctgtagctcccatgtagtacctgacacttggtcgttcttttggttttttttgagacagtcttccgctctgtcgcccaggctggaggttacagtgagccgagatcatcccactgcacttcagcccgggtgacagagggagactgtctcaaaaaaaaaaa

SEQ ID NO: 404311 - DNA, 681 bp, Homo sapiens
aaggacactgcccccgtgctagagggcttgaaggaggaagagatgactaaggaggagatcagcatcctcagcaatgcctgctctaagctgcaggaacagaagaagtcactcaccaggaagaaggaggagctggagctgtggcagggccggttctcacctgcagttttccttgtgtatcggagctctttcttaactttctattttcccccaattctttaagcagtcgattggcacagagttttcccacggggggctgcagtggatttactgtgtcagggatgagcctggctcgggttggtggggctctgaagcacatttggggttctttgtagcttctaatgtgaggtttgagtccagtgcacccacagcagcatacccttctcaccccttgtggtgttgcaggctcaggcccctggggtcctttaacaacataggatttggaagacataggaatggcacaggcagccaggaaagcagctgcgctcagacgatgccttctccattacttgaagcttctttttgttcagccattaaagaaacttgacaaaataggaacaggagatatttctcaattgtaaacctttgtgcagggacagttggcttccagaggctttcagctttcagttatttgagaaagaagtttgttttagatccttaatatttatgaattctcaaaaaaaa

SEQ ID NO: 404312 - DNA, 707 bp, Homo sapiens
aaggacactgcccccgtgctagagggcttgaaggaggaagagatgactaaggaggagatcagcatcctcagcaatgcctgctctaagctgcaggaacagaagaagtcactcaccaggaagaaggaggagctggagctgtggcagggccggttctcacctgcagttttccttgtgtatcggagctctttcttaactttctattttcccccaattctttaagcagtcgattggcacagagttttcccacggggggctgcagtggatttactgtgtcagggatgagcctggctcgggttggtggggctctgaagcacatttggggttctttgtagcttctaatgtgaggtttgagtccagtgcacccacagcagcatacccttctcaccccttgtggtgttgcaggctcaggcccctggggtcctttaacaacataggatttggaagacataggaatggcacaggcagccaggaaagcagctgcgctcagacgatgccttctccattacttgaagcttctttttgttcagccattaaagaaacttgacaaaataggaacaggagatatttctcaattgtaaacctttgtgcagggacagttggcttccagaggctttcagctttcagttatttgagaagtttgtttcacctacaggagtgggcacctggcacagtgagatcctccttgggtggccagtgaactgcttcag

SEQ ID NO: 404313 - DNA, 330 bp, Homo sapiens
gagcttgtgatccacctgccttggcctcccaaagtgctgcgattataggcatgagccaaaaatttttaaaaatttttgtagagagaagctctcactatgtttcccaggctggtcgtgaactcttggcctcaagcaatgctccctcctcggcctctggaagcactgggactggcctgtttttgcatttttaaagtttggatgaaaatgctttgtgacatcaaacttttttgtgaactacagattaattgactaactagaattatgctatcagttgaggtctgtagtaagttgagtgtcatttaattggtaaaattgtcagttagtttttat

SEQ ID NO: 404314 - DNA, 462 bp, Homo sapiens
aaagttttaaaaaagattcacgggtagaattgtgctataaatccagcccatagtggagtaagttagagtgagcttctacgatagtatggtaaactgagaataatactgggagatggaatgttatcttggcttatatggtttcagtaaggaaattttaaaggaatctgagtgaggttatactaaggggtaattaatgaagtatctgtcctctctatgatatagagaattggtaaaacttttatcaaagcaagccattgaacctctcctttcacatttgctctttggttgccatttatatttgagtgcttaacactcatagtcatttatttctaaattgtccatttacctattctttgattaaagtataaataatagtgcttatttaataggttttcaaattaataatttgtgtgactatatattactcttatggtaaataggtatttaataaaaatacttaat

SEQ ID NO: 404315 - DNA, 382 bp, Homo sapiens
ttttgagaaaaaatcttattcttgttttgttctcttttgctagtacaatacgttgtataatgtaggcattcaataaataattactcaattgagttatgatttgtaagaaacctatcataaactagatgttaatatatgaatgcattttcagaaattatgttaaatgttaatttatgtaaaattcaagccactttcatatttccttctgagtaactggaaaatataaaaagaaaataataaacttaggaatctgatataggcacacaataaatatttattaaataaatgaatgaataagttagtgaccaaatgaatacattttcttactctcatttaggttgcctttttctagggaatattatctatgcttctgttgagtagt

SEQ ID NO: 404316 - DNA, 540 bp, Homo sapiens
cttgagacctgccacctagaagggtcagagtgatactcagcctttctagttagtacctgtatttcattaggtctgggttgtcatttaaaaaactctccaagtgagcaaagcaggatactgttgctctccagatatttgaagggtatttggggataggaacacacttgttctggaatgtaatgtttcagctgccagagctaggaacatttgagggaaaggcaggaggaggcaggtttttattcaggataagaaggaaggtgggttgaggaagaagggtaacattttttatcatttgtattgcataaaatacataaagctttcacagtaaccctggaagatagcatttcgatgaggaaactgagattcagagatgttagtgacttacgtaagatcccacagtttattagttaataacaggcatttgaacctagttcagtctggtgacacaaaagtaattatgtaatgctgcctctctcattggtaagtacctgctatagaatgtgctgtctgcctaacacccttagtttatttaaaaaaaaa

SEQ ID NO: 404317 - DNA, 445 bp, Homo sapiens
tatgttgaagatcagttgtcttgattctacctgtgtacatcctgcttatttctgcggtttttactttatagcatactccaccaatcctttttaaggaaaaagcaaaatcctattatgggaatgcttcaaaccactctgagcttccagattaatctgaaacagcatctgagttcacaactgggtcagagttgcagaatagcaagagaaacttgccagttcagcaggcgtgtgtcttgggttagttaagacagcaggacagtcctgaggcctgacttccttgcatgtgtttcaaccttgggtgctgagataattctgggtggctttagataactttgtttcttaactgaaaaaggagtgtctgttgcctgataagtgtttatccgtgaaatagcaacatggtgtgcatcttagggtaggagggcttttagatctccagagaccagga

SEQ ID NO: 404318 - DNA, 217 bp, Homo sapiens
atgggatttctccgtgttggtcaggctggtcttgaactcccaacctcaggtaatctgcctgccttggcctcccaaagtgctgggattacagggtgagccaccacgcctggcctggaacttcttaaatataaagaatatctacaaaaactatagcaaatgtcatactcgatagtaaaatattaaacactttcctattgagttggagaatgttacaaga

SEQ ID NO: 404319 - DNA, 420 bp, Homo sapiens
cgcgatcggaaggtggcgccacgcggcccctacaggcctgggactcccacccgagctcgcaaagtaggtcggggtctgaagctgggggcctagagcaactagcttcttggaaagcgactgcaattatttggggtaatatactctgttccagagacgtccaccccccacctcccacaaaaaaaaaccctgcacttaatttaaatgttacgttatatatacatcccatcatatacatatattcacacataatcactatgtaacagtccaggaagaaatttaatatttgggtaaattacatattcacacatcttcacataagtaaaaccagggtatccagacaaaaaaacaatctactaacctatatctgtttcccataggtcatatctggtctgggggtaaataaatacttctgacctcact

SEQ ID NO: 404320 - DNA, 646 bp, Homo sapiens
ggggtttcaccatgttagccaggatggtctcgatctcctgacctcatgatccacccgcctcagccttccaaagtgctgggattacaggagtgagccaccgcgcccggccttttagcttatcttgaaatccaccagcctaccttctgttcatggcacgagcagtgatttcagtgaaaccatcataaacattcttgttccactagacgctgatcacagcagtgatgtttctgtgttaacaccctgtactgtccctcgagtactgtacctttgtgcttgcacacgtgtcactaacgcacgtgttaccagagtctcacgaccctacggtgctatttttattggtgcaaaattaaaccctctcagctgaccgttgctggataggatcagaatgcaggaaaagagcctctatggcaatacgattgtccttttttcgtttcagagtcaaatgtatctattttccattcgttaacttgcattacatactgtacccatggaatttttgttttactttttggggctggttttgaaaggaaaaaaaacggaagacaaacattggacgccattatacatgaaaattatatagaaaaattaatcatttcattggaagcaagttgaatatgtgtaataaaatgtttttccataacagttt

SEQ ID NO: 404321 - DNA, 240 bp, Homo sapiens
agtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggag

SEQ ID NO: 404322 - DNA, 460 bp, Homo sapiens
tagttcagtgtctgcccagttggccgcccagttttgtgcttgaaacccagggccctggtggggtagtcaccagagggaatctcctggtttgcaggttgtgaagaccatggaacaagtgcagtatatgtgcccaagttcctcaggctgagaccctcacagcttcccttgggtcagggggaaaatttcccgattccttgcgcttcccaggtgaggtgacaccccaccctgcttccgctcagcctctgtgggctgcacccactgtccaacctgccccggtgagatgaaccaggtacctcagttggaaatgcagaaatcacccaccgtctgcatcgatctcgctgggacctgcagactggtgctgttcctattcggccatcttgaacctctctcctgatccctgagttttcagagagactgatttgagtaataataaaactctggtctcctgctcagccagctc

SEQ ID NO: 404323 - DNA, 484 bp, Homo sapiens
atgcaacaacctgtgaagtaggaactattatctccactttgaatgaggtactgagtttcagaggctcagcaacttgcccaaggtcattcttctggtaaatggtgttgctggcattccatcccagttcattctgtctactggaggccatatttataatcactcactcccctatcgtgcctcctaggcttcccacgtggcattcataccactccacaatgcatggaccagtctaggctcccactgaatttcttatcctatggcaataaggcatgctttccagcccagggtaaaagagctttttctctatttgtgtttctgcattgttaagcctgttgtcatacacacagttgctcctcagtagcttatttcttgactcattctaaacatatggtaaacttctaaagttaaaaaaagttagtgttatattgagatgaaatatctgtgattaaaaaaatgaacatcatgtcacaatataaaaaagaaa

SEQ ID NO: 404324 - DNA, 231 bp, Homo sapiens
atgcaactttctgtgggttagctaaatctttagtgtgtcaggtagtcgaaagaaatttgctgtatagtgctgtgaaatatgctgcatccatgagccctctgctctttgcccatagggagcaaagacacaatctttttgcaagctgtcccagtgccatattgaccatcttccttttacagcaaaaagttattgcttcctttggttaaggttgggacacccctctggaggcac

SEQ ID NO: 404325 - DNA, 637 bp, Homo sapiens
aacaaacaaacaaaacagatccatttgtctctctttttgggtaatgaattaagagttctgaacataatagagtgcgtggtttcccgtgcttctttgccttaaaacctatgtccttcagtcccttctgcatttaatataatgtgcattctttgcatgcttaccaagtagaaattttttgcttaggatggagcgatagtgagtttaaaactatctatagagttatagaaagcttagcattctttcccacaaggggaatttattagaaagctaaatgtctttggtaaaacaccaaaatcttacatacagatgcttctcactcttacacagagagttccactgagaaggcagaagaataaggtgcccatagtcatttaggagtcatttcaaatggtgctctatagtcttcagtgccaccatgctgggagggctgaccctcttttcagtcaggtcttttcccttacctgttttctgcttgggttccaaataggatttttgtctagagggtgaaaaagaaggcatcctacttaaggcctgaaaagcacacttcagagaattttatttgactcaatgaatgatgcttttctgactgagcaccttcttggtgccaaaagcactatattagccactagggacacaa

SEQ ID NO: 404326 - DNA, 464 bp, Homo sapiens
ttcaaagactgttaaagcattcctattttgataaatccaaaggaagcgccttctttacatggaaaataaattgttgctgaattggaaaattactaggcaatttagtgatgataattttagtgatgatatgggatgcaaggctggttcaacatacacaaatcaataaatgtaatccatcacatacacagaaccaatgacaaaaaccacatgttatctcaatagatgcagaaaaggccttcgataaaattaaacactgcttcatgctaaaaactctcaataaactaggtattgatggaatgtatctcaaaataataagagttatttatgacagacccacagccaatatcatactgaatgggcaaaagctggaaacattccctttgaaaactggcacaagacaaggatgccctctctcaccactcctattcaacatagtgttggaaattgtagccagggcaatcaga

SEQ ID NO: 404327 - DNA, 449 bp, Homo sapiens
aagagcagtaggtcaccatgacttcaccttccaggagaagcgccctgttggctctgaagcttgctagaaaaaagaaaggaaggaacaaattatagagaagcattttactatggtccaaatatttgtttcagccagattaaattttatgttagaagtacacatttatggctgggcgcagtggctcatgcttgtaatccaagcactttgggaggccgaggtgggtggatcacctgaggtcggtagttcaagaccagcctgaccaacatggagaaaccctgtctctactaaaaatacaaaattagcccagcgtggtggcacatgcctataatcccagctactcgggaaggctgaggcagcagagtcgcttgaacctgggaggcggaggttgtggtgagtcgagattgcgccattgcactccagcctgggcaacaagagcgaaactccgtgtc

SEQ ID NO: 404328 - DNA, 692 bp, Homo sapiens
ggcggatcacgaggtcaggagatcgaggccatcctggctaacacagtgaaaccctgtctctactaaaaatacaaaaaattagccggtcctggcgtcaggcactacttaggaggctgaggcaggagaatggcgcgaacccgggaggcggagcttgcagtgagctaagatcccactactgcactctagcctgggcaacagtgcgagactccgtctcaaaaaaaaaaagggatgtttcagaaagataaaagggtcaagtaaacaacgaaggtactggaatcagaccttcaaaatagataaaaacaaaatttgacgggattaaaggatctcctcatcatagagaagtccacaaccataattggaagtttgaatacctgtctcaataattgacagaagtagtagattaaaactaccagtaaggacatagaagatcagagtaatactgtatgtaataccacccaccttgacataattggcatttatagaacacaaaatccaataattatagaatatgcattcttttccagtatacattcagcaagatagaccatatatatggtggaccataaaataagcttcaaaagattgaaatcttagactttgttctttgatcataatagaattagaaatcaataacaaaaaatctggaaagttctctgatcacaatagaattagaaatctatagcaaaaaaaaa

SEQ ID NO: 404329 - DNA, 528 bp, Homo sapiens
agatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattaactcaaaagttgagattttggggtggtggtgtgccaagacattaattttttttttaaacaatgaagtgaaaaagttttacaatctctaggtttggctagttctcttaacactggttaaattaacattgcataaacacttttcaagtctgatccatatttaataatgctttaaaataaaaataataaaataatcctattaatacac

SEQ ID NO: 404330 - DNA, 187 bp, Homo sapiens
gcggccgcctactactactaaattcaaggccgttcgactttgttattttttctttctacccttcaaaatgaataatctatattgatctatgttctaatttgctgattgtttcttctgccaagttatatcttcttgtgaccttttctagtgaatttttcatttcagttattataattttcaactccag

SEQ ID NO: 404331 - DNA, 496 bp, Homo sapiens
cctcctgcagccacaggtgatcaaaatgaggtctgtgtgacggagcctgcagcgaggcaagatggctgcctcaaacaagtccatatttcatctctcctcctaacctcctgcctgccaaagctctggcagggaactcattacaacaaagcatgcatgcaccctaattacctgtcatacttctctgttgctggaccagaccctataagagaattccaaagaatttatttttatgggaacaaaatgcagtaattgatgttgcaatcctgcccaaatcactgaacagatcctttaacatccaaattccctaaaacagctttgacttactacacacttcacatgccagctagtgtttgaagtgcgtgtagccgcccccatgaagccctttcttactgtaagtgctcaagaacaaagatatttcttaaacttcctttgattctcataaaataaaaatagccattacataataaagcacaaagctccatgggttaagaagtcc

SEQ ID NO: 404332 - DNA, 270 bp, Homo sapiens
tgccaaaaaaaaaaaaaattgtttaactctatgcttaaccttttccattagcagtttctaccagcaaaataaatcttttccaccaccaccaaatatttttccgcatctttgtcaacacttgttcttgctgtctttttaaattttagccactctgttaggtgtgatgtggtatctcattgtggttttgattttcatgtccctgatggcaaatggtgttgagcatagtttcatgtgcttattggccatatgtttacctaccttggggaaatg

SEQ ID NO: 404333 - DNA, 371 bp, Homo sapiens
acagaaggtatgagagatgagatgccatggaagggatggcagcgatcacagaggctggggggcagaggaaagagacgttgaagaggtggaggggtaatgaacctaggcgggagacaggctaacatttactaagtgcccgtgatgcaccaaggactaggctagctatacaacctttcattgaattcttatgacaacagagaaggaaacaggtttagagagctcatgtaacttacctgtggtgacacagctagcaactttattaagattttgttacgtactatacactgtattaagcatcagtatcttatctcatttaatccccacaacaactctactagagtctcatttaataaatgaggaaacttaggctc

SEQ ID NO: 404334 - DNA, 391 bp, Homo sapiens
ggagcagtcccgaaacccacggtctgtgcctccaggagaccggtgggagcacatgggattcaccaagaaaggtaagcccccgagagcttctccctctgagtcccttcggtccttcagcattaggacggagacacattgggctctaaggaggtggatcctgaagacccagagctgtgggagcagaagatggtggcctggcaggcctagggtcaaggagggcttcctgccagtcccctccccagggcccctcctcactgagggctcctcctctcaggctgggcagaagggcccagcgatgcccctgtgaaggtggacacagaaggaccctggcagagcctggagcaggcctggggaaggggagccatcgtggctgggccaaggatgatggtgg

SEQ ID NO: 404335 - DNA, 396 bp, Homo sapiens
tgctcacgggtttgctgcccggcctccatccctcgccacacaggcttgttttaaaacacagtgtttcccggaatatggcaactgcacccctgaggttgagccatgcaagagagagagagcgggcgcccggggcaggagccatgaagcttctgtaaccgggacccgggagagacctcccatcctttctatccatactgttggttggaagtggatcagtaagcaccgcccgtgccccagggatgtggggtagggtgtgcaggggcgtgggtgccaggaggccaggatcacagggccccttggcggctgcccaccccacggtgacatgacatttggtctgagaccttcccttgccctcttagtaaatatgtaatacagctgggcctgaacacagattga

SEQ ID NO: 404336 - DNA, 230 bp, Homo sapiens
ccaaggagcagcaagagagcaggccccagtgaatatgcactttgcaagcttcagcttgtatcgcgttgctgatgagccactggccaatgcaagtcacaaaactggcccagagttaacgtgggaagtgaccccaaggatgtggatacagggaggcatgaccaaatcagaagccattacttcaacaatctctgcaaagaagagaggtttccttctcttcataatctctacca

SEQ ID NO: 404337 - DNA, 403 bp, Homo sapiens
agattcttcaagaggtttttcccccttaacaatgtaggcaagtcatgctttctaaaccaaaaggggaattcattgtatgtcacattatgccatagaggctcaggctgtattcttcatattgagaggacagtagctgtgcattttcttctgtagctgctggtaaggggcccagacttggagatgggggcctggagttctattctacctccattcacagctggctgagagactagcggtcacctgcctagtcttctgtactttagtttcctcagctcaaaaatgaaggtaatgatgacaaaaataccagcttcactgggttttgtgaagctaagatgtgcatctatgtgaatgtgcttgacgaaaagtagttattttaaaataaatttgtgttgatattataaag

SEQ ID NO: 404338 - DNA, 289 bp, Homo sapiens
gtttttagagtattaaacatatagtttgaaaggggagggcaaaattatctagcaaaataactaagttgcttttggagtttataataggaggactagatttaatttgaactgattaagaatgaccttgaggacagggcctgtatgttgaatatatgtcaagaactccatggtggctggacagatagataaacacacatatagttttttttcaatttgtttccttaagtggtgtgtaggccaggcacagtggctcacacccaaagtgctgggattacaggtgtgagccacc

SEQ ID NO: 404339 - DNA, 1197 bp, Homo sapiens
  misc_feature (1176)..(1178): n is a, c, g, or t
  misc_feature (1180)..(1180): n is a, c, g, or t
  misc_feature (1182)..(1183): n is a, c, g, or t
aggagccaggagagatagaccatgagtagagggcagacatgggaaaggtgggggaggcacagcatagcagcatttttcattctactactacatgggactgctcccctatacccccagctaggggcaagtgccttgactcctatgttttcaggatcatcatctataaagtaagagtaataattgtgtctatctcatagggttattatgaggatcaaaggagatgcacactctctggaccagtggcctaacagttcaggacagagctatgggcttcctatgtatgggtcagtggtctcaatgtagcaggcaagttccagaagatagcatcaaccactgttagagatatactgccagtctcagagcctgatgttaatttagcaatgggctgggaccctcctccagtagaaccttctaaccagctgctgcagtcaaagtcgaatgcagctggttagactttttttaatgaaagcttagctttcattaaagattaagctcctaagcagggcacagatgaaattgtctaacagcaactttgccatctaaaaaaatctgacttcactggaaacatggaagcccaaggttctgaacatgagaaatttttaggaatctgcacaggagttgagagggaaacaagatggtgaagggactagaaaccacatgagagacacgaggaaatagtgtagatttaggctggaggtaaatgaaagagaagtgggaattaatacttactgaaatctttctatatgtcaggtgccattttatgatatttaataatctcattacatatggtaattctgtgagatatgtattattgaacatactataattaatactaatgataagtaacacctcttgagtacttagtatatgctagaatcaaatttaagtttatcatatgaggccgggcacggtggctcatatatgggattacatgcctgtaatcccagcactttgggaggccaaggcaattggatcacctgaggtcaggagttccagaccagcctggccaacatggtgaaaccccttctctactaaaaaatacaaaaaatcagccaggtgtggtggcacgcgtctataatcccagctactcaggaggctgaggcaggagaatcacttgaacccaggaggtggaggttgcagtgagctaagattgcaccactgcactccagcctaggnnncngnntgagactccatctc

SEQ ID NO: 404340 - DNA, 351 bp, Homo sapiens
gcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgattcttgccccttttcaatatattttgaacttaccaattctgcagttttgttaaatatgtcaaaatactcttttcaactgcacattttttcaacgtgattttgactc

SEQ ID NO: 404341 - DNA, 471 bp, Homo sapiens
ttttttttgagacagtttcgctcttgttgcccaggctgtagtgcaatggtgcgatctcggctcactgcaacctccacctcctgagttcaagcaattctcctgcctcagcctctgaagttgctgggattataggtgtgtgccaccatgcccggctaattttgtatttttagtagagacagggttttgccatgttggtcagggtggtcttgaactcctgacctcaggtaatctgcccatctcagcctcccaaagtaatgggattataggcataagacaccaaacctggcctagaatacatgcttttacgtgctttatctcatttaacttgatccccacaaccaccagtactaatattatctccacgtacagatgaggaaattgaggctcagaggaatgaagtcatttgttcaaggtcacgcaaagtcagtagcacgctgccctcactccagatcttcatgctgccctgacgtc

SEQ ID NO: 404342 - DNA, 330 bp, Homo sapiens
tatacatgtacatgtatatacatagtcacatgtttgtatgtagatgtgcactcatgaatatatgtatgtacatatgagtgagtattgggccacaatgtaaaggtatttctcattgtagtttgtggctttaaaacttcaaataccctgtaataagcagctgaaacagtatcagttcccatctagtcaatggaaaccttcttcgaaggatctccagagtgttccttgagctctgcagacccagcagatatatacagaaacaccatcaatcaagctaaggttccagctatgtactgttaaaagctgtatattcaaacaatatgcaaatacatt

SEQ ID NO: 404343 - DNA, 276 bp, Homo sapiens
gttaaactgtggtatgtggtcaaagaagaacttgcacattagagccaaggtgctagtgaaaaaaattagtttttctgcctacatcagatatgtcagtatcaatgatcctatgaaatgtggaccatttttaaaaacgttaaaaaaattttatagaccgactgggaagttcattcatattgaagagtcatgaaactcctgtccatgtttgttcaggaagtaatcttgcatgacgattggtagatgggaagattggattccctgtacaatcagaataaa

SEQ ID NO: 404344 - DNA, 439 bp, Homo sapiens
atggtacttacatcagcaaagacatataaaccaacagaatagaattcagagtctagaaataaacccataatttctggtcaattgatttttgacaagggtgccaagacattcaatggaaaaagaatagtctttttaacaaacagtattgggataactggatattctatgcaaaagaatgaaggtgggcccttatgtcacatcatatgcaaaaatgaactcaaaatggatcaagcgtgagagttaaactataaaattcttataatcttcatcacattgaatcaggcaatggtttcctagatatataaagcacaaacaataaaagaaacacatatataaattggacttcatcacaattttaaaagtttctgatgtagaggataccattcagaaagtgaacaggtaatcacagaatgggagtattacaaaccatatctctgat

SEQ ID NO: 404345 - DNA, 763 bp, Homo sapiens
atcaatctcatactctctagagccttacttcttagagtgtagtccatagacaggcagcatcagcaccaattgtgagcttgtcagaaatgctgtgtctcagactccagcccagacctactgaaccacaatctgcattttaacaagatatccattaaagtctgagatgcactatgctaggctactctatgacaatagctggcttactctattaattgtgatgttaacctttgctgttcatttgttaattcccctgaaggaataaattactcaaatctctaagatatttaaaaacagacaagaaaacaaaacaaagagaaaatgatgacatactgatattatctttatctgtccttccagttacggccaaaatctcttttgtcctttcaatcctcaaatcactacaatctggcttatacatacatccattctgcaactggtcacctctgaagcaaccaatgacctacctttcaaaaaaagaaaaagaaaaaaacgtcactgtctgtgataatgttggctacaaccttaaaagtctctctctgctgcaattatttggagcacttcctagctatttctactacctttcatcttcatgattttcttacttctatggctgtttccgcaccttgaggtttttcttccttcctatattcattctcccacaagtttaatttatgctatgtgtggcttaaatgattacctaaatgttgtcaattcgtcccccatcacccccgcaaatcatcctctctacttccaactctgacat

SEQ ID NO: 404346 - DNA, 509 bp, Homo sapiens
tgggaagaatggcacaagaagacaagttgaaattagatgccagaactgcagattacttggttgaaatgtctttggtgttgcatttttagtccttgcgatgattggttaaattgcatactttggaattgtaagcttctattagcaccaattcttttgtaatttgcagtacagagaaaaagctgacaacttaatttttagattgctgacattttgatacattgttcttataaccctgccttacaaactaaaaacagagagagagagagagagagagaaagcagaaaggtctatattagacctagaaaacaaatgtaatatttaacctgccttgagtatatatttttctctccagttatattgggtgggtgcttgatgaggatagggagttatttctcttcaggtttctttcccaaaccaagtaaaggtctagacacttaaagcattcagtaaatacttacgaaattgtataaaaaatggggccatttgtaacttacgctttactaccaaaa

SEQ ID NO: 404347 - DNA, 598 bp, Homo sapiens
agtaatttagagagatggggcttctgatcctgtgcacatgcctgggttgggccagttttaaaacttgtcaaatgggagcttaatagagtctcctgggggctcccttgcaggcccagcaccacggtggcatcccccagttgcagctccctggtatgtattaaaaggacctattgggtttacaggtgtggcctccagtacctctcctgggatttgtgagtgtagcactattccttttcaatggcatccatctcctgatctgttggcctcactgtacctgattaataataaaactttccttttaaaatacttgtgtctgagggacagagggcagctctggtcacaggggtcacagctaatgaaatccaaccccgttctgctgctctgtggccatggtggcaccgtgtgtggcatcaccaggctgggccatgctgggctgaggctgagggctgctaacaagtgtcctttgtgcaaaaccacccattcctatgggctgcaggctcctcttctgcccaagtccataagagtccaagccagtcatactgttcagctctgcacctgccgatgacctccgagcactgttgtgtgctcagcagccctg

SEQ ID NO: 404348 - DNA, 578 bp, Homo sapiens
aaataggctcatttcctggcatttctggaatgtagttcctacatcatggccttctttccgtgctctgttgtcaggcaaatggccagtctttcagctttggccttctttaattcacagatcatgtcctagtctccgccttccccagcttccagagatcatacggcagatattcaaggtgcttttttctaaaggtctcttacttgctgctcactggtttaagataaacttaaagcatcctcctaccatataggatggggaaacaaagtagcagcagagctctctctctttctagagaaattttgttcatcagtctctcctgcttagtattctagcccttctagcctccccttttgtattgtcaaaattactaatgcaaagtggccagtcaagtttaggacacaaagcagttgactatacatggtctaatacctgtctttgaaatgtgggataagttaacctttttagcttcgatccttagagtctcaaaaaagtaatggaaaaattctcacttttatatttttttaaagctttttgaagtcaaacaagctacacataatgaatgtgaatgaatgtgtgtg

SEQ ID NO: 404349 - DNA, 333 bp, Homo sapiens
aaccccttctccctcagacccaggagtccaggccccagcccctcctccctcagacccaggagtccagacccccaaccccttctccctcagacccaggagtccaggccccagcccctcctccctcagacccaggagtccaggtccccagcccctccaccctcagatcttcaaatggaatctggggccaggcacggtggcgcacgcttgtaattccaaggctttgggaggccaagtgggaaagactgagcctaggaagctgaggttgcagggagctgtgattgtgccacagcaatccagcctgggtgacagaccgagatcctgtcttaaaaaaag

SEQ ID NO: 404350 - DNA, 232 bp, Homo sapiens
tcagtaatatgaactcagggctttggtttccatgtggccctaatggactcactctccctgttccagctaaccaacttcagccttgttcctgttcaatggagaacagcttacgctggagtctgtggttttctctgggccaccttcatctgtttttcccagcagagcggtgacggcacattcaagtcagctttcaccattttatatacaaaggggaccagtgccacagaagggt

SEQ ID NO: 404351 - DNA, 384 bp, Homo sapiens
ttctacagtaactgtccctcagctacacagaactcctcttggtccatcacatgtctgacccatctttttgggcacctgttttagagcctattctgctggaggttggaaagagacttagagagtggttagtgatgcatctggtaagggaaacatggaggttatctcagcctctgctaaaaaaggaggaggctctcattcagagcaaacacatgggccctgcagtactggaagaaagacagtgaatggccatcatgcttttccaggcgccctcagattgctcactgggctttatgacttcttaaagaaaatctattgccttattcccaaaaggatttaacgtgtcgcacagagatgagatactgtaatagaatgggataagttaaa

SEQ ID NO: 404352 - DNA, 475 bp, Homo sapiens
gtgaatacctgtggcttatttcttgagcggtttaattgacaaacacttcttaagggttcactgtgccaaaactggattacatgggtgcacatttcaaggttaaggaaagtgagtgtgcagaggagacaaacataaagaactatgatgttactgatagcaggaaaaaataagcagcagcagaagaaaagatataaaagcaagtgaactacagagagaaaaacagaacatttttaaaaagagggagctagcagaacagtaggaatagaaataaccagaaaaagtttagcatttcagatttttttttttttttttttttttttttttctttgagatagagtcttgctttgtctggcccaggctggagtgcaagtgcagtggtgcagtctcagctcagtacagcctccacctcccaagttcaagtgattatcctgtctcagcctcccaagtagctgggactacaggcatgcaccaccac

SEQ ID NO: 404353 - DNA, 392 bp, Homo sapiens
aaaaaaaaaaacaaattcaggaattcggggccctttcgtacattcacaatgttgcacaactgtctagttctgaaacatcttcatgaatccaaaaagaaaccccacgttcattaatagccactccccattcctccctcccccggcccctggcgaccaccagtctgcattctgtctctatggatttgcctatggtggatatttcttgcaatggaattgtgtaataggtgacattttgcatctagattctttggttcagcataacgtctttggggttcatccacgttgcagtgtgttttagtgcttcactcttttttatggctgaataatagtccatggtttgcgtagaccacattttgtttcttttctcttttttttgagatagagtttcactc

SEQ ID NO: 404354 - DNA, 499 bp, Homo sapiens
ccacacatgcactcacatacaagggcatattattcagcaataaaaatggagtgctgttacatgctacaacatggatgaactttgaaaacattatactaagtgaaagaatcccgacacaaaaaccacatattttatgattccacataaaatatatacactttatattatatatattgtctatatatataggcaaattcatagaaacagtagattagtgattgccaggggttgagggagggggcaatagggagtgattgctaatgactatggggtttcctttgtggatgatgaaaatgttctgaaattagataatgttgatggttgcacaactccaaaaaggtacaaccattaaaaaccgctagactgtgcactttaaaagtgtaaattttatggtatcttaaaaaactatcaatcatttaaaaattacattttaaaataggaacaatttaagattagaaaagattccttttgaaataaaaataagattgctagaattaaa

SEQ ID NO: 404355 - DNA, 473 bp, Homo sapiens
aaaaacaagcaccatcttcatacctgctgaaatctaattctcatccagagggatgtgaggaataaagggggcagtgataccaacagcgggcgtagacagcccatccatcccacgcaggtaatgaagctgatgcttagagaggttgagtaatccacccatgtctctctgacccaggtctgaccaccatactattgcctgcagatgaagaggagcaacatattgtatcctgtgttgctcaagagagcagaattaggacttagaatagccttctaagaattgctctgtgccaccaaatgggtggcagacttctagacaagttttctaaacttgtcagcctcaactacaagtgagctggtgagagaaaacaaacatcactatccaggggcttttgctggacttactgaatgtaacagagatcggattggattgtctctaatgtctgtttcacgaatagagttctgtaaatagtctgt

SEQ ID NO: 404356 - DNA, 431 bp, Homo sapiens
ctctcaaggtcctttctggaactgggattatgtataaagcttaattttagctcaagttctcaactgaaataggtaaatgatctcagctactggttaatttaatcatatattcacttacttaaatttttctcaatttcagaaatattagttacaatattctaaacctaaaattttgatcatttagtaacagcaaaactcttcataactgaaaacatcaattggtagcacgcgcttaaaaaagaaatgactacataatggcttataatgaaaatacctggtcatttgctttttatctatgaaccccaataaacatagttaggcctcttctagctctaccactttctgcctattgccttattttaactgtctccaaatgaactcttttgagaataagtgattttaaaaacaaacagctgccctgttcctacaac

SEQ ID NO: 404357 - DNA, 410 bp, Homo sapiens
tatagatgtatttacatattgtttaactaaaaacaaacaaaaaaaaaagcaaagtcatgtacaagcagaaataaacatttagaatacagaatttgtggaataaaccaaagtagacaaaaatcaaagaatttatccctggggcattcaatgacttgatacaaggtcaccttctacttagttaactgtccttgaggagtaaggagagcgcaggggcaggagagatgtctgatcctgtctccagcaactgatagacccaggttagaagttagatgaagctgcctgccagttatcttggtagaaacttctttctgcatgtactcagataagacatcagtaccctgggtggttctctgcaaaattcaaggtctgcagagtcaccaactgaagtctattggtaaacttgcttttaa

SEQ ID NO: 404358 - DNA, 1193 bp, Homo sapiens
  misc_feature (1020)..(1020): n is a, c, g, or t
  misc_feature (1056)..(1056): n is a, c, g, or t
  misc_feature (1065)..(1065): n is a, c, g, or t
  misc_feature (1193)..(1193): n is a, c, g, or t
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaatttgggctgtgcncaggggagtttggggaaatgcccgttcaccacctgnaatgtgggngttatcgggtttggggggccgcctttttttgggcgccccggagctctcgggtttttccccccctcgcggcgatttgttcggtaaaaaaggcgccctcgtggcgggtttgtttcgggcttcctctcgan

SEQ ID NO: 404359 - DNA, 2363 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaactgacgaagattaaaacccgaccaggacatccaaattagtcatactactttacccaaacaaacaaacaaaaaaaatttggggcggcccgaaatttaaaatttgggggccggagaagggaaactcacaaacggcacaggggttcaacaaacgggcagggtgaacagttgttggccagaatatcccacgccggagaaaaaaaacaaaacatacttaataa

SEQ ID NO: 404360 - DNA, 1736 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggaaaaaaaacgacacaacaaaaaaaaaaaaacaaggaagaagcacgaacacccgcaaaacagaacacaaccaccacaaatgacaaggacccgcacacgcacaccacaaccccgaatgaaagcacgggcaacccatgagacaggaagcaacccaaaacaacagggaaaacaaaagagaaataacacaaaaaacgaaacagcgcattaaagaagagccacatatcacagacgacacacactgcgagcgaacaccgcccccgcacgacacacaggagccccaaaaatcaagagacgatacaccacaagcaggaaggcaccaaaagggagcaccctcccaccaaaaaggaagagcaaacccccggacacaaataacgcgcaagagagagccaccagggagaaaaatggggggcgacaaaaaagatgcgcaccagggggcacacagcatcgggcagacaccgacccaaagcagctaatcccccatacccacgt

SEQ ID NO: 404361 - DNA, 4062 bp, Homo sapiens
gcacgagcggcacgagcggcacgagtgagtttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404362 - DNA, 1413 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttgtacttaagtgaaaaaaaataaacaaaaaaaaaaggggcgttttgggggggaaaagaataaaaaggaaggaatttttcagaccatgtaaaaggaacagggccacaagagagtataaaccgtcataaaaggaaaagagaagaggaaggtcaataaagaaaggaacaacaaatatataaaaaacaagaaa

SEQ ID NO: 404363 - DNA, 3836 bp, Homo sapiens
  misc_feature (86)..(86): n is a, c, g, or t
gctagtctggtagctttaagatagctttgccttagcaaggatcaaagtcctacccaaatatctaaaatatctagaagtataaagcnttgagctcaacgctttatacttctgtttctccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404364 - DNA, 4198 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404365 - DNA, 3656 bp, Homo sapiens
tgatcccctggccgcggcctcctgaggtgccgggagtgcagatggagtctcgttcactcagtgctcaatgccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404366 - DNA, 4401 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgagacggggtttcaccgtgttagccaggatggtctcgatctccgtgatccgcccgccttagcctcccaaagtgttggaattacaggcatgagccaccgtgcccggccaacggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404367 - DNA, 3709 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtgaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404368 - DNA, 403 bp, Homo sapiens
agctgggcgtggtggcgggcgcctgtaatcccagctactagggaggctgaggcaggagaatcgcttgaacctgggaggcggaggttgcagtgagctgagatcacgccattgcactccagcctgggcaagaagagcaaaaatccgtctcaaaaaaaaaaaaaatcttttcagcttcgtgagagatttgaaaaagtagtatcataagacattgtcagtgaattctgacttttaaacatgacatattagaatcttcattttccacagtcatattttcctcattaaactagtgatctacaatatgcctgatattgtctaggtctcaaaacacttcttgtctttgacagcagttcgaaaacttgagtaggactgttttataagagtcaattccagtttgataaggaaa

SEQ ID NO: 404369 - DNA, 4292 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404370 - DNA, 3908 bp, Homo sapiens
  misc_feature (158)..(158): n is a, c, g, or t
gattagaggatacgagacgagatgagatgaagatgaatgaaccagcagcgatgaaagcagcagctctgcacctgcctcagaggatgaggacgatgaggatgacgaagatgatgaggatgacgatgacgatgaggaagatgactctgaagtataaagcnttgagctcaacgctttatacttctgtttctccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404371 - DNA, 3690 bp, Homo sapiens
tcttactaaatgtgtagagagcgcactcgagctaagtacttccatatgttaacagaaagacagagaggcggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404372 - DNA, 1242 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaatttgtgacgcagagcaagtattggggaaatatgccaggtacacatctgaaatggaggtgttaatgcgcctacggttgcagcattctttatttgggctaacccattgaaatgctcgggtgttgatataccacaagctaagtgggggagtttaatggcttgggaaaaaaaaaaaacggttttgggaaaaagggttttcctttaagaggcttgttacttaaaaaaaaaataatataaa

SEQ ID NO: 404373 - DNA, 4536 bp, Homo sapiens
ctcgacgccagcctaggcaaaaggcaatgtatctaaacgaaaagaaaataggctttctccgctctaccgcctcgggcagccacacctccacacttccggcggtgtaccggccaaatgccgcctgccagcaacttccgtcctcctagctaaaagcggaaaacagaggctcggaaccgctgcgtggttcttgctcttcactcggccgttttaaagggtgactctttcctgtcccggcctgcgtggtgtgggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgcagttcgaaaacttgagtaggactgttttataagagtcaattccagtttgataaggaaagtatctaaatgcttttgaaaatcattgaaaagccgggcgcggtggctcacgcctgtaatcccagcactttgggaggccgatgcaggcagatcacgaggtcaggatggtctcgatctccgtgatccgcccgccttagcctcccaaagtgttggaattacaggcatgagccaccgtgcccggccaacggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacacaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcatcaatatctgcatttgtgagtgggtattcagcaatttcctgaaaaaaccaccagtgttcattgaaaatgcctttcaaaaaggttaatacacaattatgtgtctgagaatttaactgaagtatcttcaaaatctcgttaatcattaatcctaaaaaaggtaggtagcattaatacagatgttaagtttatagtgtttgtttacactagaagtatgtgagaagacactaaaagttcagaaatcttagagaaatcttttcacctgtgaaatccagtacagcaaaggtctagtgaattcacattctaaacatttttttcatctcatttaccatgtataataatacctacttggcactattttctacttgaatcatgaaaatgaaaaaaatatactaaagtctttgtactctcttagcattttctgtattctaaacaatatatttatactttcagaatagtattaagaattagtttaagtaactccagctaagttttaaaaggaaaaagaagactgcactgattccctgaggagaaatttatttgcagttacttagatgatgtaaaaaggtaaggatttacggttgtaacttggtgaaagcacttttgtgatctgttatatgttgtggttttaaggatggcgtatattacattaatctataatcaccacattgttttaaattgtttattttttttttaaagaagtctgtcttcagagtacaaccaatgtgattaattgtgcctttaacaaagtcattcaatgtctaaacaaattcagtatctgaaacatcttcatgaggaaaactgaaggaaaggaatttaaaaacacagaccaggaaacaatcacaaaatataggtttaattactacttttaaacttaaaaaaaaataaaaaccaagaaaacaaacataggtactccagtaagacttgctactctgaataatgtaacattttttctaagttctataaatatatactggaagttttagaacacatacagacgcttaggaaaagaaaggctagttccttggaaatgacgatccaggatgatacaatcacttgatgacagaaggtaagcctttcttacaattagattttagcagataattttaccactaatataaatgggtgatgtgtggatcacaagttctagaaggcgaataaaaatactgactccaggtaatttctggatactacaaaaatgaagtttgcttgttttttttagaaccaaaaatactatcttgtaaggtacaaagaaagcttgatattaagtatgaaaacataagcataacatttgtaactaatcacacccatgaaagacgactagatgacacctgaaacatttttcaaaatactgtaacacagatgagtaatattagtataaattttttatgtacattaagatctgtttcagtttgctggtgtgaccaaaccttagaaggtaatcccaagggataaagcagaacataagagcagatatttagatattagtacaggctcaatttgatgcaatcataaaccttcaagatttctagtcactgaaaccccattgtaggtagtgttctggagtctgctataagtaaatctttaatgactagatgttttccttaccatctacactgaatggaaataccatgaatatagacacattttaagtagaagactgacgttctaaatcatgctgtttgattttataaaaaaatcataatagaccctctcacctttaaaagttgtagaggagctttataataaattcttaaatatactaatttctgtgatgtctagcaattgaataatttaaacttgaaagaactaaaatactaataaccatctgctttatattacacaaggaaatatacacgtatgtacataaaaagtgaactcccttcacaaataagttcacaaaggactatgtgtaatgtgactggacattcaacaactagactagccggttgaaatcacattttcagtcctctgtaattgtgaaattttttctaatgccttgcaaaaactacagataactgattaagttcatgtaggttccttattgaagataaattgtggtataaattctatactcaagttactgaacatgagagttaggtttttccaagtgatctaacttttccctctataatctataaaccccaaaataacaatttctgtcagagagaatctgtaacagaagtgttcttgtgtgctgaacaaaaaacttctaaattgtttacaattcacttactatttaacccaaacaagtttaacaagaataagtttatactgttagcccccaatggtcatatatgattaataaacattttttgtaaactcaactatattcacacatcaagagttgagccagtgagctcaatctttaaaaaactacacttgtctaaagaaagtcttttagtgctcacttcggcagcacatatactaaaattagaacaatacagggaaaattagcatggcccctgtgcaaggatgacacaaattcatgaagcgtttccatgtttaaaataatttgaaaagaaagtattttaaacaaatccaagtaaaaataaaatatctacaagtgttttcaaatctaagaaatgaaacatgtaaagattaagaatttactgaatcttaacagagtatttccctttgtgatattgacagaagtttctcataaaatgtataaaacagcataaatgtttggtagattcactaatagtagtcatacttttttttttttacttagtattagcatttgttgaaaaaataaatggccaaagtgctttaattttcatttagaatgaaataatctggcttacctttgactaattaaagaaaatatagggtaatacaattgttcaaaatctaacacaaataggagcgtttactatttttgtctgctttaagattttaacttgatcgaaaataccaacatccccaaacaaaatttactgacct

SEQ ID NO: 404374 - DNA, 385 bp, Homo sapiens
tttctatccagattctgaattttgtgtttgtcatttcagctatttcagactggttaagaaccatttctagggagctagtgatccatttggatgtaaggggatgctgtggttttttgaattgccagagttcttgtgctgattctttctcatctgatagggttggtgttcctttaactgcggggtaagttgagtatggtcagttggattcatttctggatgctttcagagggccagggctctgtacagaatccgcatatgtgggtgaattcttgcacctggtttcacatcttgcatatataattagcatgataattttagtgtggtagtttgtgccgtgatccagtagatggcgcttaagagtaatggccgatagctaggctaacac

SEQ ID NO: 404375 - DNA, 468 bp, Homo sapiens
agtactactttctacccacacagggattggctaaataaaaggaataaatactgaaagtgcaggtatagaggactatttctctccttttttgttaaattgtggtaaaatatgtaacatatagtttcctgtcttcaccatttttaagcttacagttctgtggcattaagtatatccacattgttgtgcagtcgccaccaccatccgtctccagagctcttcatcttgcaaaacagcacctctgtacacattaaacaatagccaccactgtcctcttccccctgcctcatggcagcccccgttccagtttctgtctctgaatttgactactctgggtacctcacaggagtggaatcacacagtcctcatccttttgtgtgtgggttgtttcacttatagtatcttcaaggttcatccgtgttacattgtgtctcagaattcccttcccttttacagcatctcaattcagat

SEQ ID NO: 404376 - DNA, 90 bp, Homo sapiens
cccagcagccatcacggcccagcaaccgagccgctgccctgcctcccaagcccgcccggcccccagccgtgtcaccagccttgacccaaa

SEQ ID NO: 404377 - DNA, 414 bp, Homo sapiens
tgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatca

SEQ ID NO: 404378 - DNA, 409 bp, Homo sapiens
gtatagccatcctagtagatgtgaagtgctatctcattgtggttttaatttgtatttccccaatggctagtgatgttgagcctcttttcatgtgattgttggctatttatatgtctttggagaaatgtctattcagatctcttgcccatttttaaattggattgtctttttgttattgagttgtgatagtattttctttttaattatgaaattggtagttgttttgaccaagtaagtttgctaggtcaaaatctagaagtggttcttatattggagataatattctgcagattaatctaaagatctcttttaagatgtctctttaaaattctatactctagaatggtacatttccaggatcggcaccaattctaggtcgacgcggccgcgaatttagtagtagtagtcg

SEQ ID NO: 404379 - DNA, 1173 bp, Homo sapiens
  misc_feature (429)..(429): n is a, c, g, or t
cctctcttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgaccctgcctgtggcctacatcatcacagaccagctcccagggatgcagtgccagcagcagagcgtttgcagccagatgctgcgggggttgcagtcccattccgtctacaccataggctggtgcgacgtggcgtacaacttcctggttggggatgatggcagggtgtatgaaggtgttggctggaacatccaaggcttgcacacccagggctacaacaacatttccctgggcatcgccttctttggcaataagatangcagcagtcccagccctgctgccttatcagctgcagagggtctgatctcctatgccatccagaagggtcacctgtcgcccaggtatattcagccacttcttctgaaagaagagacctgcctggaccctcaacatccagtgatgcccaggaaggtttgccccaacatcatcaaacgatctgcttgggaagccagagagacacactgccctaaaatgaacctcccagccaaatatgtcatcatcatccacaccgctggcacaagctgcactgtatccacagactgccagactgtcgtccgaaacatacagtcctttcacatggacacacggaacttttgtgacattggatatcacttcctggtgggccaggatggtggcgtgtatgaaggggttggatggcacatccaaggctctcacacttatggattcaacgatattgccctaggaattgccttcatcggctactttgtagaaaagcctccaaatgctgcagcgctggaggcggcccaggacctgatccagtgtgccgtggttgaggggtacctgactccaaactacctgctgatgggccacagtgacgtggtcaacatcctgtcccctgggcaggctttgtataacatcatcagcacctggcctcatttcaagcactgaaggaggccccactccctttgagactgccctccctcccctgctgggtctctccaaccctcaccagccaagctggctcagcaccttgtgtccccct

SEQ ID NO: 404380 - DNA, 373 bp, Homo sapiens
tgaggatccccaaaagtgcactcttctatatctacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404381 - DNA, 1769 bp, Homo sapiens
  misc_feature (29)..(29): n is a, c, g, or t
taccatcgctaggtcgaggctgggtgttnctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404382 - DNA, 1044 bp, Homo sapiens
  misc_feature (973)..(973): n is a, c, g, or t
gcgtcgcggcagcgggaagtcacgcacgcgcaacccaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaacncgggttttgtgggggaaaggggaggcggtggtcgcccctggaaagggaatcgccaagggattcaccataga

SEQ ID NO: 404383 - DNA, 1521 bp, Homo sapiens
attttgcggttgtattttctagctttatgttggcgcatatattattttaactcaataggcatatgtcgatgctccctgtacgtggggatacccgagaaacccattgttaagtacaaaatgcagtcaatacccataaacccatggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404384 - DNA, 1670 bp, Homo sapiens
  misc_feature (29)..(29): n is a, c, g, or t
taccatcgctaggtcgaggctgggtgttnctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404385 - DNA, 1796 bp, Homo sapiens
gcgtcgcggcagcgggaagtcacgcacgcgcaacccaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404386 - DNA, 1842 bp, Homo sapiens
  misc_feature (29)..(29): n is a, c, g, or t
taccatcgctaggtcgaggctgggtgttnctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgagaggcgattctacggttcacctgcgcgccggcgtcacagcgctaccgcttcctggccgtccggctcgcggtgtgttttataggcagaagcaatgttggaaaatcatctctaatcaaggctttattttcactggcccctgaggttgaagtcagagtctccaaaaaaccaggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404387 - DNA, 1539 bp, Homo sapiens
  misc_feature (29)..(29): n is a, c, g, or t
taccatcgctaggtcgaggctgggtgttnctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagagcttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404388 - DNA, 1638 bp, Homo sapiens
  misc_feature (29)..(29): n is a, c, g, or t
taccatcgctaggtcgaggctgggtgttnctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagcagctgaggaagctgctgtacccgctgcaggaagtagagcggttcctcgccccctacgggaggcaagaccttcacctgcgtatctttgacccaagcccggaggacatagccagggcggacaacatcttcacggccactgaacggaaccgcatcgactacgtcagctccgccgtccgtatcgaccacgccccggaccttccgcggccagaggtgtgttttataggcagaagcaatgttggaaaatcatctctaatcaaggctttattttcactggcccctgaggttgaagtcagagtctccaaaaaaccacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404389 - DNA, 1673 bp, Homo sapiens
atgcgcgggcccgggtatgtggctgaaagatggtaatatcgttgcaacatatggcatactcgtgcctcaaatgcagatagtgtacccgcgtattaatctagcacagttaccaaagcgctctctggcttgaggtgcgtgcggtctgtcgcagcaaacatccagcatgagagatacgctgtgcggtctaccgcagcttgaatggtaatcatacagcgggtcccaatcggcaccctctacgtgagtcggcataaagcttcacctgcgtatctttgacccaagcccggaggacatagccagggcggacaacatcttcacggccactgaacggaaccgcatcgactacgtcagctccgccgtccgtatcgaccacgccccggaccttccgcggccagagggacacacaaagaaaatgaattttttcaaagttggaaaacattttacagtggtggacatgccaggttatggctttagagcacctgaagattttgttgacatggtagagacctatctaaaagaacgaaggaacttgaagagaacatttttattagtggatagcgttgttggaattcaaaaaacagacaatattgccatagaaatgtgtgaagaatttgcattaccttatgtgattgtattaacaaaaattgacaaatcttccaagggacatcttttaaaacaagtgcttcagatccagaaatttgttaacatgaaaactcaaggatgttttcctcagttgtttcctgtaagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtatttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagatttattacaagaaatgtcctttcatgggggaagtaacattttcactagtgaaaaagcaaaaaacaaaaatagctttaagtgagaaaactaatttgtaaagggcaagagaaaaaagctgatg

SEQ ID NO: 404390 - DNA, 747 bp, Homo sapiens
cttcgtgtatgtcttttcctgaaccctgtgctgaattttccaaggagcctagttactacattgtctaaaactaagaaagagcagacataatgtaggcccttcggcccccttcctttttggttaactgagttatgccaatttcagcagtatgctgactgtacacttcattgtattttagagaaatctgtttcgctgtgaatgcataaaggctaaggagggaggaacaacccttgtttgctgctgcatctcttgggacttgggcaaattcaactttgcacgtggcagatctcttgggaaagccacttgggttttaaagggaaatattttaaaggtaattccaaggttgttaagtaatttttgttcacatggttgagttttcttcactgtgggactgagactgccgcagattacgttactgtcagttcctcactttttccacttggcaagaaaaaaaaaaagattcggcctggtgtggtggctcacgcctataatcctagcactttgggaggccgatgcgggcagatcacctgaggttggagttggagaccagcttggctaacatagtgaaagcccgtttctactaaaaatacaaaaaattagccgggcgtggtgatgcgtgcctgtaatcccagctacttgggaggctgaggcaggagaatcgcttgaccctgggaggtggaggttgcagtgagctgagattgcgccattgcactccagcttgggcaacaagagcgaaactccgtctcc

SEQ ID NO: 404391 - DNA, 472 bp, Homo sapiens
actatacttatatatttattatacatcgctctcttgatattgccatggattagaagcattagttctcagtacttgaagacaaacttctaaaaagaaaatatatgctctgaacatctgaaatgggctagactttcaagtaaaattgcttcatttctcattaactgaagagctattgatccaagtcatacttgccatttaatgtaaattatttttaaactttgctgtacaaaaccattaagtgtaaaggattcttcatattcttagtatgaagcaaattatgaattttaaaaatgaaatatgtattcctctaaaacccaaacttttatctttccattggtatctttgaattttaagacacttttcttcaaattacaaaacactaaaactcactcctaaacttcactttgagaaacttttttaaccaattataaaaataaaaccatccccatgtgtttcttgcatattctaaaaa

SEQ ID NO: 404392 - DNA, 668 bp, Homo sapiens
ttcatccttgctttccttgattggtggtttttatccctttggggaataatagacctatttgagaatctagtgagagatatagacttcccatgtctacataaagttttccatgtaatatcatggattcatggaccccagatttaataacctcttctttagattaatttaaatcatcttattacccttctacagtgatttggataggaacacaccagccgcatgatgtgagacttcccagaaggactcattcccagaagagatcctcccccttttttccgctcatttttttcttgctttctcttttctatcacttccactggaatggacctcaaagagcagttctgctctggtcctttttgttttcttttaaaaaaaaaaataggccaggcacggtggctctcacctgtaatcccagcacttcgggaagacgaggtaggtgggttgcttgaggccaggagatcgagaccatcctggctaacacggcgaaaccccatctctactaaaaatacaaaaaattagctggcgtggtggtgggtgcctgtagtgccagctactcgggaggctgaggcaggagaatggtgtgaaaccgggagacagagcttgcagtgagctgagatcgcaccactgcactccagcctgggcgacagagcaagactccgtctcaaaaa

SEQ ID NO: 404393 - DNA, 376 bp, Homo sapiens
ttgaacattgtcctcaccacaaaaggaaacttcatgtctattgccatgctccatcatccccctcccctactttaagcagccacttatctactttccatctttttagatttgaggattctgaacatgtcatataaataaatagaattatataatacatgatattttgtaattgacttttccacttagcataatgctttaaagttcatccatgttgttgcatgtatcagtatgtcatttctttttttttgtcaagtaatatttcactgtatggatatctaacattttatgtatctattcattaattgatggacatttggattgtttctactttttggctattgtgaataaagttgccattaaaaatgtctgtataata

SEQ ID NO: 404394 - DNA, 264 bp, Homo sapiens
ggagagagaataaaagggagggcagagggagagagtgtttaactgcatatctaggcctagtgttttagtggtatttataatattgcctatattgttatagacataaggagtaagcagcactctcagctgcgatctctggaccatgattggatacatgattcagtataaatacccttcccatttgctgtccaaaatatctcgcttcacagctggaccctaagaaacagagtgagtgggcctcccccatgtcctaggagagctgag

SEQ ID NO: 404395 - DNA, 518 bp, Homo sapiens
cttttagaagcactgttgatttcaccacagataaatattttgtttgctattcttgaatatgtatactcaaggggagttattgaccagtttgaatgacaacgaagcctttacaaagaaaagatttagctagtgggcagaactgacctggacctggcctgtaacagttacttcaagaagcaggaaaaaaacctaaatgtttctactgtttactacccaggactgaacagaagtagctgtgcaaccaccactagaagccttctgagcgtgttactgaagaggatgaggcaggaggcttccagaggcaacagccaagactaagccatcaaccacagggccaaacccagtaaaaaagaaaaataagaacacttccacttaaagaactgctgcaattatactgttcctttttttttccattaacatgtctttccttttatgatggcgagagttaatattaaggtgtgcgtatatgtttgttaaacgatctcattttgcaattaaaagtttgcacttatattaat

SEQ ID NO: 404396 - DNA, 584 bp, Homo sapiens
aggatgacgtggcctttgccattgctgagaacccattttgcacgcaatgttttcccggataataaatgacacagctgggatttattcaggtgttctgactccaaagtccttgctcctgatcaccatgcgctaccgactttgagcagtgatgtctcacagatgggaatgattcctctgaagattgaatagagaatgccaccatgtgaagtgatatttgagctggaacctgagtgaatgatggaatggagaagtcaggtacagagctgtggggatagcatcacaggactgaacagaagtagctgtgcaaccaccactagaagccttctgagcgtgttactgaagaggatgaggcaggaggcttccagaggcaacagccaagactaagccatcaaccacagggccaaacccagtaaaaaagaaaaataagaacacttccacttaaagaactgctgcaattatactgttcctttttttttccattaacatgtctttccttttatgatggcgagagttaatattaaggtgtgcgtatatgtttgttaaacgatctcattttgcaattaaaagtttgcacttatattaat

SEQ ID NO: 404397 - DNA, 376 bp, Homo sapiens
ttgtatgttctcactcataagtgggagctaagctatgaggatgcaaaggcataagaatgacacaatggactttgaagactcagggggaaagggtagaaagggggtgagggataaaagactacaaatagggtgcagcgtatactgctcgggtgatgggtgcaccaaaatctcacaaatcaccactaaagaacttactcacatagccaaacaccatctgttcctcaataacctatggaaactttaaaaaaaatgaaaaataaaaaataaaaaatcatctaaattggaaaaacaaagaccgttaacaacgtctgactctgaagagtgtactttaataaggtgggggtaggagttaggataggtgaggggttggagggag

SEQ ID NO: 404398 - DNA, 887 bp, Homo sapiens
tgactacctctttgctgtatgaatatcttaattttctaatacctcagtttcatgagaactgtatgtacatttttgtaaataaaataatttaccatatactaggagaaggacctgcttttaaagaaattgtgtaaagacatttgttattggatgtgttacatagtaaatcaatttgaaatttcttaaaaacgtttataagacttttctggtctccttgaccgagggattttagtataagtatttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctccctccctccaaactgtggctgtaaacagtgactctgcatagtcagcgttatacttgatttctttgtgaatgcaaataaaataaaatttgtaagtccaccaaatattgacttaactaggtaaatgt

SEQ ID NO: 404399 - DNA, 251 bp, Homo sapiens
catacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcac

SEQ ID NO: 404400 - DNA, 569 bp, Homo sapiens
accattccccctctaaacatcccacacacaccccattccccctctaaacatcccacaccgcggtactcaagcagtgtttgcctggctttggttgagagttcccggcaacaatgagggctgcagtctaattatacttagaaggaaatattgatcttggtttccatgatttatagtacaagtcatttccactttaatttgagttaccaagaatggacacattagtgcaggatggaattgaaatgtattgggcactatagaaattactttggtctctggctttgttttttcacctcagaaatgtgtatttttttcttcctgccattgcagttctaattttctgtgttgtgtctctgggaggagtgagttggtgcacctgctcatcctgattcatgattttcttgtgcctgtcagtctgagacaggccacactgatgtgtttgcatcgggttgaaggctgagaattctgactcagacctggcgaccctggcctctcctttttgcagaccttagaaaagtgagtgactcactgtagaacccagggctacgcagccccttgccttcctggaggaa

SEQ ID NO: 404401 - DNA, 422 bp, Homo sapiens
gagagaaattatttcttgcttggggatattgggaggaagggctatggtgtggtgagaaaagcgtgagctgtgtgcggtggtaagtgcctggagtccctgctatttgggaggctgaggcaggaggatcgctggagcccaggaatttgaggctgtaatgtgctataatcacacctgtgaatggccactacactccagcctagcaacacagacttcatctcttaaatttaaaaaagcatgacctaaacgtgaatttcaatcctatgtttgttgcctaaccttggcaaatgtacttgccctctctatgactcagttttatcacccgtaagatgggaataatagcaataatatgcctaatagagtttttgtgagaattaaatgagattatatatagacattgggcttagcaaagggcctggcacttc

SEQ ID NO: 404402 - DNA, 213 bp, Homo sapiens
agtccatagaaataagttttctcatacagtgatagtgacagattttaggtgaaattattgctatttagatagctaagtcattcagccaaggcacatcttctccaggatgtgtctctgtgtggtggaactgggaacactctgcccatctctgatcatctccgcagatgcccaccttcaagtgccctctgaaggccagctccacttatgaaggag

SEQ ID NO: 404403 - DNA, 242 bp, Homo sapiens
gcactgactgtacttaagactcattgtattacagggctggcaagtggagagtgaagacttggaagcagccagcacagggccacatgatccttgacccctgctgtggaccactacagcacaggcacaaggcgatggccagcatctgacttcatgggcagccccaggcagctctggggtgtgggcggtcagcagtgctgacttattagtcagcgtaagtcagcgctgagagatgctacaccctc

SEQ ID NO: 404404 - DNA, 443 bp, Homo sapiens
ctcattcccttttatttagagtaaggatatataggtacagaactagtgggctatcttgaccaccaggaaatacagctgcattcactatcaatctgaattttgccaggtggggtgaagacacagtccaccccgttaggcccatagcaattccgacataaaggttgaaaggtaagtttcttgcttaagaatgattcctgtttctagcacctgcagtctccaaccactgccccaggctggaaaaaaaaagaaaagttgaggtgactggagaaatcattttgtagtttgtaccagtgtcctcctctatcccttctccagatccaccataaaagaatttgtcaagtggggacccactcttgtccccctcatgttgaatgtgcatacacatgaaggtatatatgtcagcccttcctgcctttatcaccccctattttagacaaaaaaaa

SEQ ID NO: 404405 - DNA, 293 bp, Homo sapiens
tgttcaagggtcaaccatgctcctgccttccctctcagtgtcctcctcttcctcccctcatcctgtgccctgcctttgtctcttcctaaaagattaggtttgccacttgtttccctgatagaaagtgttcggttctggagcattagctgagtaagtagcagtcagggccacttgagtggccagaagtgccaggaagacaaagagagaaagaggctttttccttccttgcagcttcgagggctacaagcagagccatgtcttccactgtgcctcacacaactggggatcctcaa

SEQ ID NO: 404406 - DNA, 7186 bp, Homo sapiens
  misc_feature (1531)..(1531): n is a, c, g, or t
  misc_feature (5636)..(5636): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagnccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagca

SEQ ID NO: 404407 - DNA, 703 bp, Homo sapiens
  misc_feature (703)..(703): n is a, c, g, or t
tgtggctgctacagctcccagacaacttggccacccggaggcaacaggatccagtcttttagataaacaggccactgggcgtcgacatggccgcaaagtttgagtaggacactctgggaagacaaagttgggccttcttggctgagacccgatacccaagctcctaaaggagtcctgtaccggccggtattcatttgttccgggtttctggaccagcaaaaatggagtattccaggtggactgacacggtatacgatccctctcttcagaggtgaaaaggattaaaaggagttgctgacaatcatcccagaacagtcctaaatccattaggcatgaaacaatgaagtaggcattctgtggactacagtgagtttctgaaactgaggtaagagacggagtctccctctgtcaccattgcactccagtctgggcaacagagtgagattccgtctcaagaaaaaaaaaggaaagggaaaaaaaaatagctttatacctcttcctggtctcaacggccaggaaaattctggaacattccaaattcagtggaataatccaaaacaaaatttataaggtttaaaataatttgacttctaatagtaataagtatacctttaaagaggcctcaggggtatataatcttctaaacaggtaccaatttcagggcagtaccatttaaccagtagggtcctctagttggggaacn

SEQ ID NO: 404408 - DNA, 730 bp, Homo sapiens
  misc_feature (730)..(730): n is a, c, g, or t
ggtggctgactacagcgtcgccacgagcaagttgggcagccggaggcacaggatccatatctgattacgattaacaggtcacatggccgctctgcttttacacaggcaatgtttgaggtaggtacagctctgtggcaacgacaaaacgttgggactcttctctggcatgagaccctgattacccaagctcctaaaggagtcctgtaccggccggtattcatttgttccgggtttctggaccagcaaaaatggagtattccaggtggactgacacggtatacgatccctctcttcagaggtgaaaaggattaaaaggagttgctgacaatcatcccagaacagtcctaaatccattaggcatgaaacaatgaagtaggcattctgtggactacagtgagtttctgaaactgaggtaagagacggagtctccctctgtcaccattgcactccagtctgggcaacagagtgagattccgtctcaagaaaaaaaaaggaaagggaaaaaaaaatagctttatacctcttcctggtctcaacggccaggaaaattctggaacattccaaattcagtggaataatccaaaacaaaatttataaggtttaaaataatttgacttctaatagtaataagtatacctttaaagaggcctcaggggtatataatcttctaaacaggtaccaatttcagggcagtaccatttaaccagtagggtcctctagttggggaacn

SEQ ID NO: 404409 - DNA, 426 bp, Homo sapiens
aggatggggtgcagtggcgtgatctgatctcagctcactgcaacctctgcctcccgggttcaagtgatactcctgcctcagcctcccgagtagctgggagtacaggtgcagtagagacagggtttcaccatgtcggacaggctggtcttgaactcttgacctcaggtgatctgcccacctcagcctcccaaagtgctggggttacaagtgtgagccactgagcccggctggaaaatttattttcagtctaaattgtgataaatgaaagtttcacagttttaaggtattgaatgcaaggctcaattggaaatgatgtttgtaaccaattacttggccaatggttcaggtctccagagaggtggtcctctccataagccaaagcatgtgttactgttaggaactgggaaaaataaaggttggcctttt

SEQ ID NO: 404410 - DNA, 376 bp, Homo sapiens
tactactactaaattcgcggccgcgtcgacctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcaaaaaaaaagtcgacgcggccgcgaat

SEQ ID NO: 404411 - DNA, 3596 bp, Homo sapiens
  misc_feature (1531)..(1531): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtaagggttttgtattactcttgctttttgtttgtaatgacattctagaagagggggatatgtatgtcttccacacacggactttatgccaaagtaagagaagcccactgacaacagtagactaagctgtactgaaaaggttctttttagcaagatttctgtggtagagttatggaaaagggtgtcatttcctttcactacgtcttaagtgagacaattatagcagaaaaagaatttctaggatttaaactgttaaaaacagtttgagtgaaatccataagtgcaacaaaattattacattaaatgaatatgttatttaaaaattgattgtttaagctaggtgtggtggtgcccgcctgtagtcccacctacttgggaggctgggatgtgaggatctgcttaaggtcaggagttccaggctgtggtgtgtcattgtacctgtgaatacccactgctctccagacggggcaatataacaagaccctgcctctaaaaataaaaagcaaataaaaattga

SEQ ID NO: 404412 - DNA, 4755 bp, Homo sapiens
  misc_feature (1531)..(1531): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggtaatgagaaatttatattgacatagttacatttcataaactattaatgattatgctttaattataccagaaattatattgataaactgatagtcgtgtgtgctcaattttgtattgagacagtattttaaattaaaagtgcaggctgggcgcggtggctcacgcctgtaatccccagcactttgggaggccgaggcaggcagatcatgaggtcaggagattgagaccatcctggctaacacggtgaaaccgtttctctacta

SEQ ID NO: 404413 - DNA, 4037 bp, Homo sapiens
  misc_feature (1531)..(1531): n is a, c, g, or t
  misc_feature (3932)..(3932): n is a, c, g, or t
  misc_feature (3945)..(3945): n is a, c, g, or t
  misc_feature (3975)..(3975): n is a, c, g, or t
  misc_feature (4003)..(4003): n is a, c, g, or t
  misc_feature (4020)..(4020): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcngaagttagttctngaggaccactgctttcttgttcctgcatgnctgctgttaagatgctaacagcatgtgncacttgagttccttggntatgaaactgaagggtg

SEQ ID NO: 404414 - DNA, 191 bp, Homo sapiens
gagtttcagttaacattttgtaatggaaatacatttagagagaattttatttttcttttagttgtgtaaaaaacagtttcagtacagtgcctctttgcgagcacatcttattcgtcataccagaaaagatgcaccctcttcatcctcgtccaattccacgtctaatgaagcatcgggaacatcatctgaga

SEQ ID NO: 404415 - DNA, 2811 bp, Homo sapiens
  misc_feature (1531)..(1531): n is a, c, g, or t
  misc_feature (2811)..(2811): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtgagacctagcccgcggcgagggggcgggctggcgactcgttgcctgggcaaggctcgctggcgaggcctatgcgtacccacgagtcggagggtctcggacgcctctgggcggcggagctgctgccaggcggagccgagagggtgggggacgcgaaaggagccgcacttcccaccctcggccgattcaccacccagccn

SEQ ID NO: 404416 - DNA, 4896 bp, Homo sapiens
  misc_feature (3346)..(3346): n is a, c, g, or t
ttggcagtttcatatagttcctcttgcatgaaaacattgcaactcacatgaaaatgggtggagctatatagtcatcttatgattagagaaacaaataactgggaataaataaaaaaaattacctcagcaggagaacatcatttataactttatattttttgggaaaaaagtatattttacattctaataaactctacatattttatgggacatgaatgtctgcacatatgtactgaaatgtgttaatgtgcacagactaaataatatattctgttttcagttaacagtattaaatttgacttgttaatattttcattgtaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagnccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagca

SEQ ID NO: 404417 - DNA, 5183 bp, Homo sapiens
  misc_feature (1531)..(1531): n is a, c, g, or t
ttttgtaatagttttatttagggaattactgggaaaataaagtcattatacccaacttgaatgtaaagctatgcttgctgatttttggagaataaaatgtctgggctaaatgttggcttttaataaagtggagctgcccattgtcattacccttgggtcttaggtaacctgggacccagaagaagctagaaataaacactacctgttctcactacagcaagtttagctttactcaggaagacaatttgaccactgggaaagcattttattaaaacgtttgtttctattggcccaaaggataatgcgtgcatcagtaggcttctcagtgcttacaggtggtgttttggcaaaaactgagtggagggatttttttaactcttctacaacctagctgtattgtttgcagatttgaatgtattcacttaatatattaaatatttaatattaaatatcaattaacttaaaatgtttagtttttttatttttttgagacggagtctccctctgtcacccaggctggaatgcagtggcacaatctcggctcgctacaacctctgcttcccgggttcaagcgatcctcctgcctcagcctcccgagtagctgggacttcaggcccagtagagacagggtttcaccatgttagccaggatggtctccatctcctgacctcgtgatttgcccgcctcggcctcccaaagtgctgggattacaggcgtgagtcaccgcgcccggccaaaatatttaaagacagtatgacaggagagtggggttggcctgacacgtagaccagcctcctgggttcgcagagggtgcatttggtcttctgctctcactgcccgaccccatgggggaaagaggtgcatctccatttttaaattcctcctttgagctatagtggcaaactcagcaactaagtagatcccaagcctggtagtttcttttttcttctgggccttgagagctcatgtccccgcacctggaatctttcaaggatgtccgggccatccgggaattactgcgtgtgcacacacacaaaaacacgcccctaacaccagaggctggctgtatgattctgttttcgagcctgctgtattcacctgtctgcccgtcagctacttctaggagcgtcaaagggcctcacccagagactacagaccctccggtggagaagtgtactaggccgtgtctgcagctggagccctcggcctgaaatgttctggctttagcaaagcggcgacagtgtccaaccccagtccccgaggagggatgtcagccctgggcccctgtgagcgctgcagattcgtcccaggaaagggtgaccggggtcgctgctccgggattaccagctaaatacctgtattagcatcctcagcacgcactgggagacgcagctcaagtccgctccccttcttgcaccctcatatatatttggtgcaaaatggagaaccttttcccctacgtttgtgtaaaaatatatgtaaataaagccttaaaatagtgttaccgacccccttttccactcgcaataanattgactataaatgctgataattccaaaagaatctcgactcttccttgagtagtctggagctagcaggtgcaagtttagaaacaataactcatcactgagggaggcactgaaaattttataactgttaactggaatctaaatttccatgtaaatgggctgtctctggtcccgtgtcaagagactaatatttttccagaagcctgaaaatatgcttttatgatgttgggagtctcaaacgtaaaaacggactcctaaccctctggatgtttcggctgaactctcaactgtccaccagctccccctacacgtggctccttagaaagcgtggaaaagggaaaaatgaaaagagaaactgccaggacttaagatgtctgcttaaagactccctcgaactgcagtgaagggtcctacccgcttccaaaatgtccacccgcattcctgacgtcactggatcggctccatcaagccagaaaacgagagtgcgctccaatcagggctcagtccccgcccttgccttgcgtcacttccggtggtgcagcagccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaagaacagtcctaaatccattaggcatgaaacaatgaagtaggcattctgtggactacagtgagtttctgaaactgaggtaagtttgcccgttcaccatatggaatgtattatgctacactggatcaagagtttatttatggagaaaaagaagatgctccaagagatggccttgattaacagttaagaaagcaggacacagagctagaatggggagaaaaaaagtcgaacacagactgaca

SEQ ID NO: 404418 - DNA, 441 bp, Homo sapiens
aggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgtaagtggtactctccagtcagctttaagatttgtaactagtgtactagtatttgcagccttggtgacttatttttctcaaaccactaagactgcttattgaataagacaaaatggcagtgtactgtgttatataagctgaactgcctcttcatttatcataaatgttcctgttattttttcagaatgaacttaataattacc

SEQ ID NO: 404419 - DNA, 877 bp, Homo sapiens
tgataaaagaatggacatcctttggatgggtaagtagaaatgaagaagatggaagtggggccattccattctgaaaagatacagaacacaggatttttgcatcagcaacaataagtcaaatcttctggttagagatagaagtatcctatcctatcaatgaggaggcattaaaaagtttaaaagtaaaattgtaatcattctgtagaggatcttggatgcccagaaaaatgacaacaagctatgcaaaatttctgaactgagaagtgataattaagaaatacaaatgcagcagcttgccacgttgagaatttcaaagacacattaagtactggttttctctttatactctgtcctggatttctctacaaaagatgtcagcagagggaataaaagacatcatgaagggagactgaatgaaggatttgtctctaattagatgtaaaaagaaaaaaaaacaaagatgaacttgagcttttcagtctggtgaaaaacaatgattcggatcttaaatacgtcttccaggtagtcatgagtcaatagcaactgtgaattcaaattgcaactggaagaataccgagactggaattacgaagttgatgtacagtttcctagggctgccctaacaaattactgtgactgggtggctaaaaacaacacaaatgtattcttccacagttctgaaatacagaaatctgaaatcaaggtgttggcggagtcatgctccctttgaaggcattagggagaaccctcccttgcctcttccagcttccactgactcctggtaatggttcgctgtggcagcataatgccaatttctgcctgtcttcacacgaccttctctgtgtctctctgcctgtgtgtctcctcttcttataag

SEQ ID NO: 404420 - DNA, 778 bp, Homo sapiens
aagcattcagctacagacttgccagtaaaatgtactcaacataaaatttcaataaaaataaggatactggtgcttattaaacaggtagattttataacggtataaaatgttgccaggctacacagctgaaagaaattacctttgaaatcctgaggatgtaaaaaaattttggattgtcactcttattataacacttgtagatgggtcttaagagtagggaatgtcttgattattgagatgtacaattcaagtttctatggccatcaccatcatctggacatattttgttgaaaatcacatgggaaaatggtgtaaccagaaacaagacatggctatccaaaggatcaaactcaccaggacaccataaagactggtaaattttaggatgaaatgcaaatgtattctatatattaaaactaaaaaccattttagtaagttatttttaaatgtacctgatagcaaaggggctctgtatgtgccacgtgagggctacgtgaggactgttcatgaaagcataaagtagaaggcaacccaaatacccatcaagcagtaaatggataaataaaaccgtggcgtgcccatggaatgaaacaataagcaccaattcaaaaagacatcaatccatattatcgccatgggaaaacaagaccttaacatggataaaaacaatataaagcacaactcaaaatagtatctcacttatataaaatgttttgaaacctacctacaaaacaatttataagtgtgtacgtgtgtgtgtgtgtgtgtaagtatatag

SEQ ID NO: 404421 - DNA, 688 bp, Homo sapiens
ggaagactaattttaaactcaggctataggtcaaatctcaacttaatatgaagaaagctctcaaaaggaaaccttttcagtgtgcagactaagaactgtccgctctaagtgaagcaaatgcaccagtagcatttacttaccctaaatattctataggatttgagacacagtttctggatacaggatctaaaaatagttaaaggggcaatacctgctaatttctctatcattgatggctttaacaacttctttcatccactattccctctatataccaggaccctagcccaagggagacacagtagaaaaccatttaaaaccaaatactacattggaagatgaacttctttgttgaactgagagtatacatacactttcaaacagccccagcaaaaatgtttgctaatcagcaagcaaagcactgtcttaagagctttcagagatgataaggaggatgttgatgatagtggttaacatttaaaaagctcttctcacacaacaggtactgtgctagctaccttgtagtagtcactgaatctatgaagtagacactactggtatatccatattacagataaacaacctgagacagtgaagattaagtaatctgtccaagatcacatatctgatacacaacagaagccaagatagggaaggtatctctgactttaaagactacataattaac

SEQ ID NO: 404422 - DNA, 437 bp, Homo sapiens
agagatctgttgtgagatctgcaacagaatgtaagggctcttccatagctctcattctaattaaatgtgttaccaattaattcacttaggatgcttacagcagacagaagcataggtatatgcaggttaaaataaaagcagtaaggccgggtgcagtggctcatgcctgtaatctcaccactttgggaggctgaggtgggtggatcacctgagctcaggagtttgagacctgcctggccaacatggcgaaatcctgtctctactaaaaatacaaaaattagctgggcatgtggtgcatgcttgtaatcccagctactcaggaggctgaggcaggagaattgcttgaacctgggaggtagaggttgcagtgagccgagattgcgccactgcactccatcctgggcaacagagcaagactccatttcaaaaaaaaaaaa

SEQ ID NO: 404423 - DNA, 320 bp, Homo sapiens
caggggcattatgggcagtttcatatggggtacaataagatctccaattctatagggaggctgaagctgacctcctaggagccatctcctaaggaaagtgggggtctatccagaggggcttaggggtcgggcttctcttgagacacagcggcagtccacaggggtgtcttgttccagtgagtcgtcagcctgcacagccaccgacacattatgtgggcttgcggtgtggtggggagagaggaaaggccaggagggctgggagaagggagagcagtgggcgaatggaagagagatgaagaggaggaaagtgtttggttttc

SEQ ID NO: 404424 - DNA, 365 bp, Homo sapiens
aactttacaaatcatctagtgcagaaacaataatgaaaaccgaacccaaacctcagaattcttttttaaaaaaatcaatgttaacattctttctacactaagaccatgtacctgtattttcccacacacgcgttcagtttgtgatcatatgtgtgacatgttttccttcattctgatcatagtttaggaatatattcgggtatgtaatttatttcactttctattataagcatgttaatgtgttgctacataatcaacattttattttgattattgaacaataccctaaagcttgactgcaagacttacatttactactgttgtttgatatttttatcactgcaataaacaccttttattatagt

SEQ ID NO: 404425 - DNA, 435 bp, Homo sapiens
tgagccagtcttaccttctccagacaccctctctcttagcaggttttttattgttggtttttgtcagccaaaatatttgtgagtctccataactgaatgtgatcccttcttctagggatgctggtgctttacttgcaagatggatatggtgatagtagaatctcaggcactgtaatgagcctggctactatggaaagaacttcagcatgagcaggagtctaatctggcattgctaggacttttggtagccatgatataaaacagttgcagagtaggcttgtcccagcggggaaatctggaagggcttcgtggcagtgacatttactaggcccttgaggactgtgaggattttgcctagcagagagagggcaggtagagaccactgtgatcctggaagcttttgaccctgtttggaatacaaatttataccaaaaa

SEQ ID NO: 404426 - DNA, 379 bp, Homo sapiens
cattcagagagaatctcagagaaaaatgtctacacagagaaaaaagttcaaaccaaagcactttgaatagcaaaaaggggtctaaaatatttaaatcatgattttgaagtatttcttggttgaaaaattggtttattttattgcggaactgtaaaataattatctttaaagctttttagaaataagatttgttgtaaaaatttaaataacatatgcatgtacattaaagcaaatagcttttaaaaatcgattacctcaattattttgccctatttatttgttgtagttgaaaaaacattacatttatcatcctaacaatttttaagcatatagttcaatagtgttaaatatattcatgttgttgtatagcagatctcta

SEQ ID NO: 404427 - DNA, 458 bp, Homo sapiens
acctcccccacttttgaccatgtgccaggcactgttctagtgctgggaatactgtactggacaagaaaagtccctgtattcatggagcttaccttttattgggcttgggggcagacacataattttaagtaaataaacagaaaatttaaaatggtggtaagcgtcatgaagaagataacatggtaatgagatagagcagtggttctcagaggcgatccccagacctgcagcatcagcatcacgtgggaacttatttgaaacacacattctcaggcctgatgagcaaggtgggagatgagtgagaaggtggctggggccagagtatctagagctgtggttctcaatcatggctgcacgttagaatcacctgaagagcttcaaaccaatccccaaggtttagcgtcagaaattctgatttaattggtctgatgtggggtttgagcatcgttaaaaaaaaa

SEQ ID NO: 404428 - DNA, 475 bp, Homo sapiens
ttaaggtcttcttggccaaccacagttatcttcggaaaactttacttgctatccctttaaaacatcaatgcattattttgaggccgtatcattgtcatgttgaagatctagtggacttggtggtttttgtctcatattggttattcctttttctccctctggcatggcctgtgtgatagccctagttttctcacagtctgctgtctgcaaaagggagatactaccagcaaagaatctcaaaacaacattttcacctttgtcattggtaaaaataatttaacttccagttaaagacaaagtttgcagtaaacaatttgtttattctttatgagttaatctttaaaaccgcaagtggtagataactggtgaactgaattagctttattagaaaaaaataaaacaagctgtaaagactacatatgattattaccatgaaaattcttcctagaatccaatgaggaagttaaaggaaaaa

SEQ ID NO: 404429 - DNA, 3012 bp, Homo sapiens
  misc_feature (1806)..(1806): n is a, c, g, or t
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgtgactgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgagagaaggtgggctgcgccacaggaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatggctcttcctcttctggaatgttgctgacccagngccgtggacttgggctggagcactgtttagacacacatagacctgcaggcctgttttagtatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagctctgttcccttcgcctctactgcgaggcctggggagatgttgttttcatgctgcttccaccatcacactggggtttctggatgggaaataaaaaaataaaggcagttcatttcccca

SEQ ID NO: 404430 - DNA, 738 bp, Homo sapiens
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaaggtatggtctgcgctgttctgagcaggagcctgctactgccaggcattcagacttcttccgggggctgccaagcctggccaaattccacccctctcacttcccgccccaaccccagaccatctcactctgctacccatcagagaaacccttcatagctccaaccagtgacattgaatgactgtcactctctgtttgattaaatttgaataaagtgccaga

SEQ ID NO: 404431 - DNA, 1351 bp, Homo sapiens
  misc_feature (145)..(145): n is a, c, g, or t
acaagttggatgaagacgcctcccctaacgaggagacgggggacgtccccaaagacacactggatgacctgttccccatcgctaccatttggccaaacaaccggctacaatggctcttcctcttctggaatgttgctgacccagngccgtggacttgggctggagcactgtttagacacacatagacctgcaggcctgttttagtatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagctctgttcccttcgcctctactgcgaggcctggggagatgttgttttcatgctgcttccaccatcacactggggtttctggatgggaaataaaaaaataaaggcagttcatttcccca

SEQ ID NO: 404432 - DNA, 4154 bp, Homo sapiens
  misc_feature (39)..(39): n is a, c, g, or t
  misc_feature (171)..(171): n is a, c, g, or t
  misc_feature (861)..(861): n is a, c, g, or t
  misc_feature (1195)..(1195): n is a, c, g, or t
  misc_feature (1385)..(1385): n is a, c, g, or t
  misc_feature (2282)..(2282): n is a, c, g, or t
  misc_feature (2943)..(2943): n is a, c, g, or t
  misc_feature (3549)..(3549): n is a, c, g, or t
  misc_feature (3874)..(3874): n is a, c, g, or t
tgagacacagtttgctctgtcacccaggctggagtacantggcactatcttggctcactgcaacctccacctcccaggttcaagagattcttctgtctcagcctcccagtagctaggactacaagtgtgtgccaccacaccctgctaatttttgtatttttagtagagacngggtttcaccacattggccaggctggtctcgaacttctgacgtcaagtgatccacccgactcggcctctcaaagtgctgggattacaggcgtgggccgccgcacccggccatttgcttttgattttactggctcataggtggaagggacttgccttgcctcagatgaaactttggactttgactttcaagttaatactggaataagttaagactttgggggactgttgctaaggcacaattttgttttgaaatgtataaagaacataatatctgggaggggccaggggcagaatgatatggtttggctctgtgtccacacctgaatatcatctcaaattgtaatcccagtaatccccatatgttgagggcaggacccagggcaaggtgactggatcatgggagcggtttcccccatgctgttctcgtgatagtgagtgaattctcacaagatctgatggttttataagtgtttggcaagttcctgctccacaccatctctctcttctgccgccatttgagaaggtccaagtttgcttccccttcgccttccaccatgactgtaagtttcctgaggcctccccagcaatgtggaagttccatcgatagaagagtggctgtgacccgaaggaatgtctgacccccacagcagtcctctcctgccagagccactttccagcagatacaaactntacgaggcagagtttaccagcccgagctggccctcgacatccccggatactcacccagctctgcccctcctggaaatgcctgaagaaaaggatctccggtcttccaatgaagacagtcacattgtgaagatcgaaaagctcaatgaaaggagtaaaaggaaagacgacggggtggcccatcgggactcagcaggccaaaggtgcatctgcctctccaaagcagtgggctacctcacgggcgacatgaaggagtacaggatctggctgaaagacaagcaccttgccctccagttcatagactgggtcctgagagggaccgctcaggtgatgttcntcaacaatcctctcagcggcctcatcatcttcatagggctgctgatccagaatccctggtggacaatcactgggggcctggggacagtggtctcgaccttaacagctctcgccttgggccaagacaggtctgccattgcctcaggactccatgggtacaacgggatgctggtgggactgctgatggccgngttctcggagaagttagactactactggtggcttctgtttcctgtgaccttcacagccatgtcctgcccagttctttctagtgccttgaattccatcttcagcaagtgggacctcccggtcttcactctgcccttcaacattgcagtcaccttgtaccttgcagccacaggccactacaacctcttcttccccacaacactggtagagcctgtgtcttcagtgcccaatatcacctggacagagatggaaatgcccctgctgttacaagccatccctgttggggtcggccaggtgtatggctgtgacaatccctggacaggcggcgtgttcctggtggctctgttcatctcctcgccactcatctgcttgcatgcagccattggctcaatcgtggggctgctagcagccctgtcagtggccacacccttcgagaccatctacacaggcctctggagctacaactgcgtcctctcctgcatcgccatcggaggcatgttctatgccctcacctggcagactcacctgctggccctcatctgtgccctgttctgtgcatacatggaagcagccatctccaacatcatgtcagtggtgggcgtgccaccaggcacctgggccttctgccttgccaccatcatcttcctgctcctgacgacaaacaacccagccatcttcagactcccactcagcaaagtcacctaccccgaggccaaccgcatctactacctgacagtgaaaagcggtgaagaagagaaggcccccagcggaggcggtggggagcatccacccacagcaggcccaaaggtggaggagggctcggaggctgtgctctccaagcacaggagtgtatttcacatcgagtggtcatccattcggaggaggagcaaagtgttccnggaaaaggcgaacaccaggaaagacaaaacaaagacccatttccctatcgataccggaatgcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacnggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcangcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtngctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctcaaaaaaaaaaccg

SEQ ID NO: 404433 - DNA, 2055 bp, Homo sapiens
  misc_feature (183)..(183): n is a, c, g, or t
  misc_feature (844)..(844): n is a, c, g, or t
  misc_feature (1450)..(1450): n is a, c, g, or t
  misc_feature (1775)..(1775): n is a, c, g, or t
tccggagacacagtgggatccaaaaaagtaccatgtaataacatacatgatttctgcagcaaaatgttacactaagcaggacaaagatgtaaagtccctcacacatcaattgaggttattgtgctgccctatcaatttacttaaacttccaggggattttcagttttaacactgaatgttccnggaaaaggcgaacaccaggaaagacaaaacaaagacccatttccctatcgataccggaatgcccacagtcgagctgcttgatctggacaccatggaggagagctctgagataaaagtggaaacaaacatttccaagacatcctggattcggagttccatggctgccagtgggaaaagggtcagcaaagccctcagctacatcacaggagagatgaaggagtgtggagagggacttaaagacaagtccccagtgttccagttctttgactgggtcctccgaggcacatctcaagtgatgtttgtgaacaaccccctcagcggcatcctcatcatcctcggcctcttcatccagaacccctggtgggcgatctcaggctgcctgggtaccatcatgtccaccttgacagccctcatcctgagtcaggacaagtcggccatcgctgcaggatttcacggctacaatggggtgctggtggggctgctgatggccgtgttctcagacaaaggtgactactactggtggctgttgctacccgtcatcatcatgtccatgtcttgccccatcctctccagtgccctgggtaccatcttcagcaagtgggacctcccagtcttcacactgcccttcaatatcactgtgactttgtacctggcagccacnggccactacaaccttttcttccccacaacgctgctgcagcctgcatccgccatgcccaacatcacctggtcagaggtccaagtgcccttgcttttgagagccatccccgttggaattggccaagtgtacggctgtgataacccctggactggaggcatcttcctcatagctctgttcatatcctcacctctcatttgcttgcatgcagcaattggatccaccatggggatgctagcagcactcactattgcgacgccctttgactccatctacttcggcctgtgtggcttcaacagcaccctcgcatgcatagcgataggaggcatgttctacgtcatcacctggcagacgcacctcctcgccatcgcctgcgcactgtttgctgcctacctgggtgctgccctggctaacatgttatctgtgtttggattgccgccctgcacttggcccttctgtctctcagctctcaccttcctgctcctgacgaccaataaccccgccatctacaagctcccgctcagcaaagtcacctacccagaggccaaccgcatctactacctgtcccaggagagaaacagaagggcatcaatcataacaaagtatcangcctacgatgtctcctaagtttccctgtctaaaacacatcagtgtaaattcaggcttcagcacgccgtccagatccccaggataagagaccacttagccttccctttggtctgttctgtgactctctccccaaacacaaagaagcgtgtatgtagtcaccattccagaacctctcttttctaagatgcacaacacttatcaaagatatgtttagtttagactttatacccttagctttcccataagagctccctttgtggggaacttgccctcttctgcgaaataagcctcatccttaaagagaagtcaccggccgggcacggtngctcacgcctgtaatcccagcactttgggaggccgaggcgggtggatcacgaggtcaggagatcgagaccatcctggcgaacatggtgagaccccatctctactaaaaatacaaaaaattagccaggcatggtggcgggcacctgtagtcccagctacttgggaggctgaggcaggagaatggcgtgaacccgggaggtggagcttgcagtgagccaagatcacgccactgcactccagcctgggcaacggagtgagactctgtctcaaaaaaaaaaccg

SEQ ID NO: 404434 - DNA, 146 bp, Homo sapiens
gagatgacttttcacagtagataatatgactactaccagaatgcaagtctcttgccctacagaccagtgctgtttccactatccccatctgccacattcagaacagcagttagttgcagcagttatcgattacaggcaaagcagac

SEQ ID NO: 404435 - DNA, 450 bp, Homo sapiens
agaagtgtgcccaaggtcacaccacagagcctgagctagaacacagatgggctacattgtggtcttgctccatcctcccagcataagttagctccctctccctccatggggacacatcccaactcctgttagtcctaccaggcccagggctcttttcagggccctgactcccccctgagaaatggaggcatagtagaggatcagataaaggaataggggagcatctcagagttgtaacaactgtcaccaggtctacttctgttcatccaagtcaccatcaatctcccatgacacaggtgaagcaagtgaggtgtgtggcccgcaatccagggttagtggcagatttgaggcttggccttgccttgcttctttaactccctgtaagtcatgttctcacctatggctcatcctctggcagcagaaagccccccaagtggcaaaccccactca

SEQ ID NO: 404436 - DNA, 501 bp, Homo sapiens
gaggtattggggtgcttcttacagtctttcaagaatggactttaggactccttcttcagcctttgatgatgtaaatggagttagggcctcagtttttctgtgatatttggctggagtagagcagttattgtctaagtgttttctctcttgctgggctgccccttttctagtcctttggccagagagagcaggcttttgtctcttctctttttatctgtgcatactggcatttctgggttgctggttcttcagtttcatgccatggatataggaagggaaaagaaaactgagggaacccactaccacgttttcccttgggaaacgtttgttttttagaaaatgacctgggcttttagtagtgcttagtgggaggattaggggaaaggatgtttactccatcttattggaagcagaattcttctgagctatttttaactggttaagacttcatgtatttaatggtcttgtctagtaaaatttctactatatggtattcggata

SEQ ID NO: 404437 - DNA, 367 bp, Homo sapiens
acatctaggattttgccactacactatgctacccaacactgcagttactaaatacagtgcttgatggcttctaagttttccttcaatatgagacagagagagaaagattcctccccagcaaaaaggaatttttttcttagcctttatttctagagttcagatttttttcatttgtactcctgaatttttttttttttttttttttttttttttttttttggggaggggggctcccttttgcccccaaggggggggccccctttggggtgggggcaggcccccccccccgggtcccccccttttttttgtctcccccccccaaaaaggggggaattgggggcccccgcccccccccaaaccttttttt

SEQ ID NO: 404438 - DNA, 535 bp, Homo sapiens
ggaggaatctgtaaggacttcattgatgaggtggcatttgcaaagagaattgaaggatgggtcagattacaccagatatttttgagagagttggtaagcagtcgtacatgaaacagagtcccagaagtaagaagtcttacaggataatttatcgtttctagttcaaaaagagcatggtaaggtcaagattggacacaggcgtaaaactgacaaagcaatttgagactacatcttggggacttggaatctttagtgtattgagcgacagggaactgtggaaggagttcaaaagaggacccacatagcagctcatttgggaatattcacttggaaatgttctgtaagatagtttcaagtcttaggagtccagaggtgaagctgccaggcagcagacagatgtaacagtttgggccgaggtaataaggcctaagcgaaaaagagatgaaaagataatggatatgacagttctatgtatcaaacatttcaaagttcaattcacaggaattagcaagtgattgcatagataaaggagaga

SEQ ID NO: 404439 - DNA, 505 bp, Homo sapiens
tgtgaggtgctgagtagatactggctgaatttgctcttaaacccgtccactctatcacagctgctcttgtcaaggttgtcagcggtttctgtgccatgggtcagccttggtgttggtctcactgaacacatcaacagcaccagcccagtcgatctcctcctcctgtcggcactcgacctccaggcctccacacacccttggtcataagcctctccttctccgttgcctttgctcgcccccctttgccccagctcattagtgtgagagtgcacagggccctccctccatctccacgcacccagcgtgcagcactcccagctccatgcctcggcccgcgtccagctgttgactccccggaggtccagtgggcatctcacactgaacgctgagcacttggatcttttcgccgacgtgctccaccactggctttcccatctcggccgatggcagctccacccttccagtggctcaggccccaaaccatgcaggcacccttgctcctctt

SEQ ID NO: 404440 - DNA, 435 bp, Homo sapiens
ctacttttaaggcagtggtgtaaggtagggatccgccccttatcccccttttgggtaatcaattgccctggaactatttatgaatacagtatctttccccgtgatttataatgacatttctgtcttgcactaagattccactaatgtttgggagcttctgggcttactgatctgtcctacttatttttatcctggccaatagcaccctgttttaattactgcacttaattaatgctgctacgtttagcaagactttatttatcaccttgacttggttactcttggctctttaagtcttgcttgcaaattttaggatcagcaagccacatttaacaacaaatcctgtcagaattctgcctggaatgacactgaatctgtaagcatcagtcctcacattcatttaaagtataatcattcattttgctggtcttcttt

SEQ ID NO: 404441 - DNA, 330 bp, Homo sapiens
ttataaaaatgggaacagatttcagggaacaccaggatggattaatagaacatgttgactcagtgggcaatagggaaaatggtgcttccttccgctaaacagaaataagaatgtcaataagagctggtcggggatggggaagaagaaaatgagtttggttcgggacaagctgaatttgaggtggcaggtggagatttacagaggatacttgggaatgagtctagtgtctgagagaggaatgcagagtcatcctcgcaaggacagctggagctctgagaacagtgaaagagcacctggggagtgtggagatgtgggagaagaggagaggaa

SEQ ID NO: 404442 - DNA, 444 bp, Homo sapiens
caaggattcgactcgtagctctagtattgactggctaaatgtccttgggtgacttaatctttgagcctcagttttctggtgtgatacctactttgagggattgctatagagtttagaaatagtatatgacaattgcatctaatacggtaactagaacattgggagttttaccgagtggtaggtggtagtatttattggttttttgtttgttgttgttttttttaaagacaggctcactctcgcccaggctggagtgcagtggcacaatctcagctcactgcaacgtccacctcccaggttcaagtgattctcgtgcctcagctactcgggaggctgaggcaggagaatggcgtgaacccgggaggcggagcttgcagtgagccgagattgcgccactgcagtccgcagtccggcctgggcgacagagcgagactccgtctcaaa

SEQ ID NO: 404443 - DNA, 528 bp, Homo sapiens
atgatgcaattgtaaaaatgcaaaaatgcctgaatcctaattttcagtgatatcctaggagcaaacgaaaaatacaaataaagtcatttgagaaaaacatgcaaattcatcagttattacataaatcccactcaccaaattacattcttaagagtataggttgctagttgccttatataaaactgccagctgttttcaattttgtaggcaaactgctctaaatgggcccctgggaactcccactacatgttgaattccatccttttcagtcctctgaaaagcatgtaatccaacaaatcaatcaaaatatttcatgtatagaaacaaagtttttcaggagggcatatatccccaaaatatttttaatcaagtatcttaatattcttagaactctggtccaaattctcttctactaatcccttgactacagccaatgcctagagtttacactaatttgtggatattttgctgttggaaaaatttaaaagtacatttttttaaatgtagaataaaaagtccttaaagatt

SEQ ID NO: 404444 - DNA, 821 bp, Homo sapiens
tccctggggcctcccctgcaactcttctctcgggctacagcagaaaagagcctgagccgctctcaggaaggacttccctggctcccagctgactctagtggtccccggagaagcccaggaatcctagcctgttctccccagccctctaatacaagatccagcagaggcccggactctgacatcgggagagtcaggccactaggtccagctcaggcacctggtctcaaggaccaacgcggaggctgccctctggtggcacgttttggaatggcgggtgtccttaaatggaaggatatgggtaaaggtcccacggagagggtaccctggtcccggaggctggccccacaggatgcagggctgggaacccctggaaggagaggagatcccggttccagatcagaagtccaagccctaccttctcgtgttccctactgggctgcacagggccgtgaatgcagtggcttcaggggaggacatgggataataggaagatacaagaaacctggcctccctgacaggtcaccccctcctccatgccccttttaggaccccaggacctggggagcaagaaaggcgagttcaggcaaactgcccgtccaacagctgtgggcagcgagggatcacatgctgcccttttcctctccacctcacagggaaaaactgagacgctccatgtccagtctgtaagtcaatggcagagccgggaccagaacctgcatctcgcagctcgtgaggcagacacttggaacctccatggagaacctgtgatgtgctgggggcaaggccaggtctctgcctttgagcctggggaggtggcaatg

SEQ ID NO: 404445 - DNA, 588 bp, Homo sapiens
atactctactcaaacatgtattgagaaccttttgtgcaccaggcactgtgccaggtgctggcagagcaccagatccacccagtctctacccttgaggagtccctctaatgggggaagacacacatacacagacaatgtcacagacagtgtgacaagggatactggtggcgagtggggacatttaatccagacttagtggcacttttagctgagcctggatgatgagtaggagttgatcagagggtaaagtaaatgccatgtctggaaaaattagtcagaaagcaatgagagaggttgagattgctggaatttagataaggctagagatgcaagcagagcctaggtctcggagggcattacaagtcaggtcaaggaatttggacttatcctaaatacaatgtggagccactgttagtttaaagtcttctggaaacaaaatgaggctttcattttgaaaagatcgctgtgggctgggcgtggcacctcacgcctataatcccaacacttttaggaggtcaaggtggaaggatctctttgagccccgcagttcgagaatagcctgggcaacaaagtgagaccccagctcta

SEQ ID NO: 404446 - DNA, 553 bp, Homo sapiens
gatatgggacctatccagagtggcggatttccgtttgacttttgccataatgctttgtccacctcaagtgagagcgaacagtaagtattggtagaacagcaaatagcttcatctgagtagggtgtttgggactcatgcacatgacaagattggaaaggcagattgggtatagggtaccttggggccaggtttaggagtttggaatttatcttataggctaccctttcctggaagcttcctcagaacctcagggcaatgagatgtttcacaagagaacgttccagggtcaggtaagtttgagaactacacatgctatatccctccctcttgaaaattcacaccatataattgcataataaaagctgaggagttctgtatttaaaaaaactggttaaacttaatgcaggactcctccctggattatagctgttaggaggtatacacttcagaaggtgctttagggggagccagtggaggtctgtgaaaagagttatgtaagcatatgttttcgaaaggtttatctgaaaacaatgtacaatctagattaaaattt

SEQ ID NO: 404447 - DNA, 270 bp, Homo sapiens
taaccactattaaagtttgcttccggatcttttcggtatgcttatatgcactctgattttaagcacaaatggttacatcttctatgtagtggttttcaactttaattttcctgcaattaaaaattaaaccgagttttgatcctgaataatatcacatcttgtagcatactttattcaactacatctctccttccttccttccttccttccttccttccttccttccttccttctttttctttttctttttttttttttttttgagacagt

SEQ ID NO: 404448 - DNA, 339 bp, Homo sapiens
ctaagcttcttgaggtaaagggtcttattgtattcttcctctgcggcctttgtagcctggaatagtgttgaatagataatccttgctctgaaaaagatttctggttgatcaaaattacaagacttgagattatccattaatgatgataaaagaattataactcatggtaccatttttgtagctgtgttagctgctctcaaagggagaatttcatggcagaggaagaggtggttgctaaggaaatgacagaaaaaaagatctggttggaggcaaatttggaaatcagcggatacaggtgtagctgaagctaagggcctgggagaagtacctgtctgagag

SEQ ID NO: 404449 - DNA, 332 bp, Homo sapiens
tgaaacagagtcttgctttgtcgccaggctgaagtgcaatggcacgatctcggctcactgcaacctccgcctcccaggttcaagcaattcttctgcctcagcctcccgagtagcagggactacaggcacacatcaccatgcctggctaattttttgtattttagtagagacagggcttccccatgttggccaggctggtctcgaactcctgacctcgtgatctacctgccttggcctcccaaagtgctgggattataggtgtgagccactgcacccagccaataaaatttatttttaactccattttcaagttgtgcactgttgcaactata

SEQ ID NO: 404450 - DNA, 631 bp, Homo sapiens
tcacaatggctgatgcaacattagcctccatggggcttcaccaactgtatttattacatttgaagacatatatgtgctttcagtggttttaatctttatagcatttaaatactcttctgaaaaagtaaaaatcttaagctacttgaattcattgtgcaaatagattaagagcaagagtcgtgataagactgggctcaaacccagattctgtcacctattggatgtgagactgtgagcagctcacttagtctctttttatctttgtttatccatctagaaaaggagtgcagtaaatagtacccagcccataaggtcattatgagaattaattgaatttagacagatagcatttagaacactgcttatcatgtggcaagtcacatgtaggtgtttggtactttagatgggaaggggttatttttacaatattactttgttccctagctctactgattattttttaaatttctaatcatgactcaatataataattatagatagacattttgatattgtgtagacatatggaggcaaatgtcggggttattgaagtcattcgaactatttgtttcaataattagaggctaaaatggatgcttttgtaagctcttgtttttgctgtgtgtatgtg

SEQ ID NO: 404451 - DNA, 393 bp, Homo sapiens
gacacaaggaaagttatatatgacagattcacagctagtaccatactaaatgggggaaaaataagtatttcctctaagatgtgaaaaaaataaggatgcccccttacaccactgttggtgggaatgtaaattaatacagccactgtagaactgagaacagaatggagcttccacaaaaaactaaaaataaaactactgtatgatccagtaatcccactattgggtatatatccaaaagaaaggaaattaatatattgaagagatatctgcactcccacattcattgcagcattatacacaatagccaagatttggaagcaccctaagtgtccatcgacagatgaatggataaacaaaatgtggtacatatacacaatggagaactactcagcc

SEQ ID NO: 404452 - DNA, 447 bp, Homo sapiens
gacaggtgtcattgcagccctggtctcattttcatctgctctggtgatggtacacagcaggaagttagctgtttgattgctaacccaaatcactcttctgttttctctacttgactgctgacaagtttaacaaagtgtgtggctcttctccttcctgcttgggtaagaataaaggtgttaaaactcatataatcccttcctttgcatgtttgttctctgtgtcttccaatgcattttttaattaaaaaaaatacatgtcttttgctttttcagaacatatataatccaaaaagattagtgacgttttgacagtcgtcagaacactaaccattagtactgcattggagtgatgctcacttttttcagagtagcatctctaaagtactttctaaaaataaaaaggtccctgctttggcctgatttttgcttctggatcatcaggtgctt

SEQ ID NO: 404453 - DNA, 441 bp, Homo sapiens
aacctctgcctcctgggttcaagtgattctcctgcctcagcctcctgagtagctgggattacaggtgtgtgccaccatgcccaggttttgactggaatgccaggcttaacgttgctcagaagttgcttctatgaggacgtctcccagcagctgtcaagtgtttccaatgagtcatcgccagcccctgcaatgagcctctcaggctggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaaaaaaaaaaa

SEQ ID NO: 404454 - DNA, 3108 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacctaatt

SEQ ID NO: 404455 - DNA, 2371 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattgagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaattta

SEQ ID NO: 404456 - DNA, 2899 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacctaatt

SEQ ID NO: 404457 - DNA, 1407 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaaaaaaaaaaa

SEQ ID NO: 404458 - DNA, 2464 bp, Homo sapiens
gttaaaagtgccataagcaataatacctagaaagtacagatgttccttgatttatgattgtattgtgtcctaataaacccataaacatatgataagttgaaaatgaacgaaataccctgataaatccatcgtaaagtctaaaaattgtaagttgaaccattgtaagtcagggaccatttgtatcaaatatagaaccatggaattatagaataggaaagtgttatgccctaaaatttttatttcattgtatcctttttgaataattggatttaggaaacttttttccctcttactgtactgtatacttcttttatttttccctttcctgtggtgctgaattgtactaaatactttaaaatctccattttaatttatttatataggatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacctaatt

SEQ ID NO: 404459 - DNA, 569 bp, Homo sapiens
tctcaaaaaaaaaaaaaaaaaaaaaaagagctcactatttgacttaagtcttcaattattatatagtatcttcttttgaagcaagagaagtactgttttattgtaagtacaatatttccaaagattgagaaaaccttcattaaaatgttctcaccatctggcacttccccccctctttgttatgtataggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtttcccaaaccactccttatgatccagtgaatattcaagagagctacatttgaagcctgtacaaaagcttatccctgtaacacatgtgccataatatacaaacttctactttcgtcagtccttaacatctacctctctgaattttcatgaatttctatttcacaagggtaattgttttatatacactggcagcagcatacaataaaacttagtatgaaactttaaaaaaaaaaa

SEQ ID NO: 404460 - DNA, 2608 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggagatgtatccttaaaggatatcattgatcctgctttcagagcatcctggatagctcaaaaacttaatttggccaaaacacaatatatggatggaattaatatagatatagagcaagaagttaattgtttatcacctgaatatgatgcattaactgctttagtcaaagaaactacagactctttccatcgtgaaattgagggatcacaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaattta

SEQ ID NO: 404461 - DNA, 3222 bp, Homo sapiens
agcgggacgcgcagcaggccccgcccacccaggcggtaggaacccactccggcccgctagacctgctgctatgtcccggccgcagcttcgacgctggcgtctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtcagcgccttcctctgctcctctaggtctgggcttcagggcacgaagagaagttagggtagaacggagccctaaggagaggtgccgtgggcgtcgaaaccagctttgaccactcgatgagggccttcctgtttacggatccttcaatttatagatgaggaagctcgggctcagagaagttgagtaactcctcaggcctcacagcctgtaagtgcctgcgtaggcaggcgagagttcaaaccagatctgcctcctaaggcaagctcctttcattcccctgctgtgcctctgcggaagcactctgggtgtaaaaagcaaacaaggtctttgtgtttgatgttggacagaaaacttggaaatcttatgattggtcacagattacaactgtggcaacatttggaaaatatgactcagaacttatgtgctacgctcattcaaaaggagccagagtagtacttaaaggtaacctttgatgtagcttggtctccaaagaacatagacagaagatgctataattatactggaatcgcagatgcttgtgacttcctctttgtgatgtcttatgatgaacaaagtcagatctggtcagaatgtattgcagcagccaatgctccctataatcagacattaactggatataatgactacatcaagatgagcattaatcctaagaaacttgtaatgggtgttccttggtatggttatgattatacctgcctgaatctgtctgaggatcatgtttgtaccattgcaaaagtccctttccggggggctccttgtagtgacgctgcaggacgtcaggtgccctacaaaacgatcatgaagcaaataaatagttctatttctggaaacctatgggataaagatcagcgggctccttattataactataaagatcctgctggccactttcatcaagtatggtatgataaccctcagagtatttctttaaaggcaacatatatacaaaactatcgcttacggggcattggcatgtggaatgcaaactgtcttgactactctggagatgctgtagccaaacagcaaactgaagaaatgtgggaagtcttaaagccaaagctgttacagagatgaacatcttttgtcaaaccattaagagttagaaagatgatctgtatcaacagatctagtttcttgcatttttattatgttgctatatacttttgttatccgtatactaaaaaaaaagaataaataaatgttttgattgtttgaatttgaaaaatacacacgaatgtcctcagtatccaggaacataaaggcaagaagcaagtcaacttacctattaaatattcctctattagatgtttcaacactataatttaattgggaaaaattgctttcagaattttattatgccatatttcccttcattatagtaaaatatatgctcacgaatcaatgctgatttttaaaatatgtataatctgaagtggaaattgtttgcttagagtttttaaaaacctagtctttgaaaagcagtttgtgctatacttttcccccaaccctccaataaatcttaaatttaaaacctacaatgtagtgtctcccctttaggttcatcaaactgatgaaaataatttttctgcttcctgactccatatagtatttatgttctctgaggtacttgaactaaatctttggacagtgagtgagaattaaaaagaatccagaagattaaatgtattcacaaaatagaagaatgtaacagtaatattttgaattggtaagttagaactacctaatattttccaactacattatttttatgaggctcatttgtaaaatttttaataataggaataacttgcagttgaacttgattctgttcactgtcacacttctaattattcatttcttcatttatggacatatataatttatttcttggctagcttgcttacatggttaaatttttctttctacatctgcaatgtatcttttttatttttattttttgtagagacagggtctcgctatgttgtccagatgggtctccaactcctgggctcaagcactcctcctgccttggcttcctaaagagctgggattacaggcatgagctgcattgtgcttttaatgatctaaagacactgattagcttctcaactagttctctttctaaaagatcaattttatacaaataagttttctaaatgtaataaagtctgttttctttctccagggaattaagaacaacattgtgctgcccttattagttcctaattacagattaaaaatctgtatctttgaactctagatttacataaatcctggcttccctgcacattttgcccctgtaaattggaatacatgatgattgaaccatctgttatgagaatattacatttcctatttacacaattgtttgtgacagagtaaaaaccattttcatagtatatgttggatcactgttgtcttcatatttctaaaataaatgaattaaaaaatttaaattcttagatgcttatctctatcatagctcagaatgcaacttcaatacccccattcttttatatttccagatttcttttaattaagatataatgaacaaattaagttaaatgaagtctgtattttcatgcaaatatattagtattcattaatatacatttattctttgcaaatagattttagttatattagctcttaaattgttaaataaattattattgaattttattattaaattattaaaatgaaaattataaaattagcactgtaaaataatatgtaaaggacttggaatgttaaaaataaccattcatcattttgctttatattacatctaatatttcctgaaacattttgtaatacccacatggaaagtggagaaagagaaaccttgtgctttttataaaacattgccaaggagaataatggttaaacaaatctgttcaaatacatatttaaatttttttacaaataaaagttttaaattaacatacctaatt

SEQ ID NO: 404462 - DNA, 556 bp, Homo sapiens
aattataaaagaaattcttatccaaatagtaatgttctaattgatcatataagaaagcaaagcatagacattagaattataagtcagcagtggtctgttcaagaacaatcaacatttttagaaaatagtaggacaaaattaggaaataattatcaccaagaggatctagttcatgactttctattatctcaattagattgctcaatcatcagccttcctatactaaactctgattcaggaccaagaaaggcatagtctgactctggaaatgcgctgttggaagccaaataacatcaatactcttgttctataattgaatatcaaataagacaaattaccattaatttaatgactgtggagttaattgtataccagcatttcagcaaatcatcatcaatagtattacattagcaatttatgcaattaaaagggctttgtaaaactttgaatagattttattgtcattagtagctgttggaacttcattattatataatgtttttgcaaactttaacttttttctaaattgttaaataaaagaataactatccttaat

SEQ ID NO: 404463 - DNA, 158 bp, Homo sapiens
tctggatgcttagaggaaggaaggaagcagggatgagagcaacttcaatgttttaattcattgatcttattaataaatcacattcccagccgggcgcggtggctcatgcctgtaatcccaacactttgggaggccgaggcgggcggatcacaaggtca

SEQ ID NO: 404464 - DNA, 388 bp, Homo sapiens
tgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccactgcac

SEQ ID NO: 404465 - DNA, 434 bp, Homo sapiens
ttcaaacccactataagcttcttgcatccatggtcactgactgttttcttactgttagctgtcctgttggacagtgtaacagtgagagagcatatacagattagcattgaaaaggataaagtgacatgtgtaagggttttgaaaaagtattatacaaatgcaaggcagatatattgaaataaatgcttattggcaaaatttcaggccagataggttggagtagtgcttcacaaactataatgtgcacatgaacaactcagggattttgttcaagtgttgatttcaattctgtagctggagttgggtggggtagaaaggatatctgagatcctgcatttctaataagctcccaggtaatgttgagtctgtaggtccttgaaccacactttaagtattaaagggttagaaagcttatactgtaactgagaaaaaaa

SEQ ID NO: 404466 - DNA, 687 bp, Homo sapiens
agcggcatatgttgttctttgtatcacaaattccaggaacatgaagataatgggtgagggtcatattgtgcaacttgtgatagcattttgggtaatttatcagccagtctggaaactacatggaaggaaagaaagaacaaaatgcctttaaacaattgttcctaggcatgattctctggggaggggtgggtgtgactgaagattcattctctgaagattgtgtctctctggacctgataaattttgcataccacacatttttcagacttctctgagctacttctctttctcacttcagtgttcattttaaaaatagtaacccattatttcacagatgcaatgtgttatttctctaaagcatgcatttcagtagagaaggggtctctaagaggggcagtaattgtcccccaagggggcaaaaattggttctttggggattgacaagagaatgttttatataacagtgatctgtggccttcaaaaactcaaccctatccaacaaaatcatattcattcttctagagttgaagtgtctttgcctgggctggagtgcagtggcgtgatcacagctcacctcagcctggaactcctgggctcaagtgatcctcctacctcagtctcccgagtagctgaggctacaggtgtgtgccatcacacccaactaatttttttttcttacagagagat

SEQ ID NO: 404467 - DNA, 328 bp, Homo sapiens
aatccaatcaattgttgccagggactcaggggaggggagaataggagtaattgatggatggaggtttccttttgggatgataaaaatatcctggaattagatagtgctgatggttgcagaacattgtgaatgtacttaatgccactgtggtacactttaaaaggattaaaatggtaaattttatgttatgtgtattttgctacaatataaacaggtccattctatggcatgtgaattatacctcagtaaagctgttataaaaataaaaggcataatagcttgttttacttaccagggaattgtgctgaggaaaaaaaaaatccaatcc

SEQ ID NO: 404468 - DNA, 373 bp, Homo sapiens
atacatggggagaaccacagagtgattaccctaattctttatattccatgcttaaataataatatttgatgaaagatattaaaatatctaaacttaagcaagggcacaaaagaaaccccatttctctgccttcaagaaaaagcaggaaaagataaaaaatttagtttggcctatccatctgataagggattgataaccataatatataaggagctcaaacaactcaatagcaaacaaacaaacaaaatccaaataatctgattttaaagcgggcaaaagatctgagtagtcatttctcagaagacagaaagtggccaacaggcatatgaaaaaaaaaaatgctcaagcatcattaactatcagagaaatgcga

SEQ ID NO: 404469 - DNA, 804 bp, Homo sapiens
cgcccagagcgcaccccgagcgccggcgagcggcgcggtgagaccctcgtgcaggtgagcccggcgcacggcggcccagaatcctggaccccaggagaagcgtctacggccccgacagagacggagtttcaccatgttggccaggatggtcttcaacttctaacttcgtgatccacgctgctgggattacaggtgtgagccaccgcgtgtggcctctgggcaccttttgaaggtggtttcaccccaacatcagcagggtggaggcggagaagctgttcctatccagaggtcagcgtggggacttccttgccaggcccagtgagagcagcccggggggcttcacgctgtccgtcaggtagctgaagcagagagagaaggcggcaggcatcagcgttttcttctatgaacttataagatcaaagactttaagactttcactatttcttctaccgctatctactacgaacttcaaagaggaaccaggagtacggaaggagcatgaaagtggacaaggaacgtgaccattgaagcaccacagggaggggttcaggcctccggatgactgcaggcaggcctgggtaacatccagcctcccacaagaagctggtggagcagagcgttccctgactcctccaaggaaaggagactccctttcccggtctgctcagtaacgggtgccttcccagacactggcgttaccgcttgaccaaggggccctcaagcggcccttatgcgggcatgacagaaggctcccctcttgccttctattcacttctcacaatgtcccttcagcacctgacccta

SEQ ID NO: 404470 - DNA, 181 bp, Homo sapiens
ggaaagacaggaactctggaaacagatttgggttttctcagtccctggatatccttgggcaagctgcatgtcttctggtgactcacttttctcagttgtggtatggaaatatcccgcttccccagttgtgaggaccaacgagaattactagtcaggtggaggggcttagcacggtgcctgg

SEQ ID NO: 404471 - DNA, 421 bp, Homo sapiens
tttttacccttggctaagctagggtcagtaagatttatgtaattctgtttatgttctgacccggagactttaatacttactttctttactaatggtttgccactgacataaccaggtgaaaagcgtggcttgcttatatgactacagggacttataacacccctataagggcttctctgaactcccacaaagccaaaattcctggtccagatcttagaggttcaaattagagacacagcctggtcccgtgtatgaaaagaaggtggccctggagagttgggatgtcaaaatgtctcttgtactcccaatgtttgcttgctttttccttctcttgctgtatcacataatttgcatttttgtcaaaaaaaaaaagtacactttgtgtaatctgatgaatcctttcaaatatatgaactgtggg

SEQ ID NO: 404472 - DNA, 786 bp, Homo sapiens
gatgcagagagctatgattgccccactgtactctagcttcggtgatagagtgagaccttgtctcaaaaaaaaacaaaacagtccaaggaggatgattacggagaatatgtcctaagaagcttaagtcactctgtgtattgacttatttgtgactcaactaggtttttatgtaattttgttgtctttgtaattgatgcaaaaggaaggtacagtctccaggctgtagatgacagacttggagaagtagtgcctgtgtgaagttgcaatcattagtcattttgtgttggtaaatgtcttcagcagtacaaaaagtctaagcgaaagccttgttcattgtccttatgttaaaataagcattgtatgttaatatatgaagatatgtaaatacttagtcactatccagatactaattgattttatgatcggaattcacatttcataaaatatggtttttttcattcattaaatgttgaacgtttacatagctaagacagtcactaatccctttgaccccagaggttaatttctactatggtgttaatttataattacaagattataaaagtgtgattagtaccatgtggcagtagagtgctttaataccatttattgtatctccaaatgctttccccaccctgtttttaatgtaggcatatggtaagaaattgaaccagatatccaggaagaaataatatttttaatttaaaaaatttttttgagacagagtcttgctttgtcactccatcctgggcaatagtgagaccctgcctcaaaaaaagacccccc

SEQ ID NO: 404473 - DNA, 349 bp, Homo sapiens
attccattttcatttttcaccaactgttctctgagcagaggtacctgacttttgcactgtgagtggtttctaatctcagtctctgtcaagcaatgctaagaaagccaacacctaaagacacaaggggtacatcatttaaatgaataatgtaaccaaacaaacaaaaaaagagaataatcattaataactcaactgatagatatgtagggagtaggcaacccaggaagtttaaaactaaattctgttactcttgagggttaaccagcccctgggaatgttatgagcaaatgatactccatgagtaaaatgatatctatgcaagtaaaataaataatttatctaactggga

SEQ ID NO: 404474 - DNA, 451 bp, Homo sapiens
ccatatttccctatattatacttacacatatatttatgttacactttctatttctcttatttacgtacattattaacaaaaaatttttggaagattgtagaaataagacatgtaggcatttgaaattttgtgagaaagagcatgtcagatttgggagttagggatttttagacattgccataagaggtaagtaaatgctgacaccttgcctatagttaataaaaatatattatacatttgaagttttctaagagagtagatttaaaattttctcactatacacacacacaatatatatataactatgttaggtgattaacgttaattagcttgattatggtaatcatttcacaacatagacatatatcaaaacatcacattgtatgctttgaatacataccatttttatttgtcaaccattccccaataaagctggaaaaaacaagacttc

SEQ ID NO: 404475 - DNA, 422 bp, Homo sapiens
ccgctgggtcctccaactacagctcggtcccacctcctctccaccagccccatgggcgctgccagcagggactgcccttctgaggagccagggttggggaagggtgcagagatgcccggccctgtgccccaacctcacctgggtgtgaccagagtagcacgtacctccagaagaggctggagctcaggggcacccaccatgctcccaaactacctctacaaaaacgaacaaaaaactgcagtgcacctctgttgagcgatatgatctgattgaaatatttgtcacgcagcacgccctctttctgtgccaagaatcgccacgtgcatgtcccttttttactgtaatatttattttattttcttggtttttttaaactggtatgataaatataaaattcaataaaagaaaagctttactgcaag

SEQ ID NO: 404476 - DNA, 1067 bp, Homo sapiens
ttttttttttttttgagacagagtctcgttctgttgctcacactggagtgcagtggtgtgatctcgcaacctccacctcccaggttcgagtgattcttgtgcctcagactcctgggtagctgacattacaagcaccacgcatggctaattttatttttagtagagatgggttttcgccatgttggccaggctggtcttgaactcctcagcctcaagcgatttgcctggcttggcctcccacagtgctgggattacaggcgtgagccaccatgcccgccctatcttctcttataaggaacaccagtcatattggattaagggcctgccctgctccagtatgacctcatcttagctacttacaaccacaaccacagtatttccaaataaggtcacatactgaggctccaggaagtacatgaattttggagaggacaccattcaacccagtacattcagtttctatttaacataaaaaataattcccatactatacagggtgaaaaaatgacttatgaaataggtgaaagattgttgaatatacaaatgtgatcttttcttttccaatcacatacagagataagaattttttgggaatatgtctcattcacaaatatgtattatatgcaaagagaaatttatacaatgttcaagtaggattcagggaattaacctaggtgcattctcttgtttctatttcaaccatattgttctccagatttttttcctaattctgatttccctgtaggattgttcagatttaaataaagcctgtaaagcagaagtagtgaacaagcctgggtactaaagttaaatattacagaggcagataaaataagtctgaggaaaattcatgcatttaattctatctattttgcccacatagttatgctgatatttcattcacttggattcaccaacctaaaatttgtaactataatggagaatcttttttctgtatttgaaaaaagtgcactgagcaaattaatagtataaatatgatttcaaggataactaagagaatatttatttctatgtatggttaatcaacatgcccccttccatactcc

SEQ ID NO: 404477 - DNA, 1020 bp, Homo sapiens
ttataacacacataccacatacactccacctcccaggttcgagtgattcttgtgcctcagactcctgggtagctgacattacaagcaccacgcatggctaattttatttttagtagagatgggttttcgccatgttggccaggctggtcttgaactcctcagcctcaagcgatttgcctggcttggcctcccacagtgctgggattacaggcgtgagccaccatgcccgccctatcttctcttataaggaacaccagtcatattggattaagggcctgccctgctccagtatgacctcatcttagctacttacaaccacaaccacagtatttccaaataaggtcacatactgaggctccaggaagtacatgaattttggagaggacaccattcaacccagtacattcagtttctatttaacataaaaaataattcccatactatacagggtgaaaaaatgacttatgaaataggtgaaagattgttgaatatacaaatgtgatcttttcttttccaatcacatacagagataagaattttttgggaatatgtctcattcacaaatatgtattatatgcaaagagaaatttatacaatgttcaagtaggattcagggaattaacctaggtgcattctcttgtttctatttcaaccatattgttctccagatttttttcctaattctgatttccctgtaggattgttcagatttaaataaagcctgtaaagcagaagtagtgaacaagcctgggtactaaagttaaatattacagaggcagataaaataagtctgaggaaaattcatgcatttaattctatctattttgcccacatagttatgctgatatttcattcacttggattcaccaacctaaaatttgtaactataatggagaatcttttttctgtatttgaaaaaagtgcactgagcaaattaatagtataaatatgatttcaaggataactaagagaatatttatttctatgtatggttaatcaacatgcccccttccatactcc

SEQ ID NO: 404478 - DNA, 428 bp, Homo sapiens
taatttctctcccgtccccacccctaaattcctgatggatgaacctagagctgtcctgtccactccaggccggactgacgtagcctatgggcccagcaggtccagggcccacgttttaatttctttttaaaaagctttaggtcttgccgggcgcggtggttcacgcctggagtcccagcattttgggaggccgaggcgggtggatcacaaggtcagcagttcaagaccagcctgaccaacatggtgaaaccctgtctctactggaaatacaaaaaaattggctgggcgaggtggcaggcacctgtggtcccagctacctgggaggctgaggcaggagaatctcttgaaactggaaggcagaggttgcagtgagccgagattgcgccactgcactctagcctgggcaacgagagcaaaactccctctca

SEQ ID NO: 404479 - DNA, 366 bp, Homo sapiens
ataagactttatgtaggtgttcaagaattttcaaaccaatcatttgtgaatgtgaatcttttctattattaacttcaaaattggtaaaattattttagaacatatactatatttagtctatgatacccatgtttaagcagcctgtggaattaaagacatatacagagtataccaaataaaattttacaaattatggtttggaaatgtgctttagacacagaaaagaaaatgctagttttcagaagtattgggattattaactgttatcatgtagcataaacattcaaattaataatcatgtacctaaattactctaaagtattgatatggttaggctttgtgtccccacccaaatctcatcttgag

SEQ ID NO: 404480 - DNA, 206 bp, Homo sapiens
cagcttgcaacattagtaggtcatggaatcaattaattgaagtacttttttttgccagcgtttttagaagatacgtttatataattgtatagaaaatattaatgcctagcacagtagctgggaaaatataattttgtgtgtgttaaaaatgctgctgtgatagaaccactaataaaatccctgccctcgacttgcttcttagtctt

SEQ ID NO: 404481 - DNA, 737 bp, Homo sapiens
tggtggagtgcagtggcacaatcacagcttactgcagcctcgaactcttggcctcaagcaatcctcccaagtagctgggactacaggcatgcaccaccatacctggctaagttttatttttttgtagacatgaggtttcactatgttactcaggctggtcttaaactcttaagctcaagtgatcctccagccttggactcccaaagtgctgggattacaggtgtgagccaccatgctcggcctacacgaactttttttaaactagcaggggttatgtgaatagtgggattacagacattttcttcattatgctggtccatatttaaatcctctccccctcgcaaaaaaaggtaaaaatatacagccataaaaaagaatggaatcatgtccttcgcagcaacatggatggagctggaggctacactctttttcatcctctatcctaaaagaagtaactcagaaccagaaaatcaaataccacatggtctcatttgtaagtgggagctaaacaatgagtacatgtgaacataaagatggaagtaatagactagagattccaaaagagaaggtagaagaggaggcacacaggttgaaaactacctattgggtactagggtcactttggatgatggctgcgctagcaggccaaacctcggcattacataatctagccatgtaacaaacctgcacgtgtaccccctgaatctaaaataaaataaatttttttttaaattgta

SEQ ID NO: 404482 - DNA, 180 bp, Homo sapiens
tgttttctccgcacttgaacaagaagtcatgttgaccccaattttttaaaagagcagaaaaaatgaaactactcatcgaaaacttatgccacaaaatttgggtcacacattagttaagtgggaggtacaataccaattacttcattgttcctgtcaaggaagccatgagtctatcctgca

SEQ ID NO: 404483 - DNA, 434 bp, Homo sapiens
ctgttttatcagcaaggtctttatgacctgtattttgtgctgacctcctatttcatcctatgccttagaatgccttaaccttctgggaatgcagcccaacagctttcagcctcattttacgagatcctctttaagatggagttcacatgcctctgacaatccctctgacctaggtctttgtgttagttttcatgtttcatggatgctctaactaaaatggctcctgctataataccattcccatcctcttagccaccacccattctttctattagttggtggaaaactttattgagaagggacttctctacgtccatctcagaggaaacatgttcctgttttctagaaccaacccctttaccacttctttcagaaacttccctcattagagggagagctgaagatgtctccctttgaaactctaaaaaaaaaaa

SEQ ID NO: 404484 - DNA, 202 bp, Homo sapiens
gagtctttcacaaataagaagagagaaatcactgcagaatgggtgactattttgcaactcttccccagtactgtgagcaacaggcatgtgtacgtaaagacacccatcacttaatactgcctgtcacagatgcttaaatggacagggtggaaaaaaatattcttttcacacacttaaaagttacttcaagttattttaaatt

SEQ ID NO: 404485 - DNA, 365 bp, Homo sapiens
ccgcccccacctggtagaattttaattccctcagtaaaattgattccaccagttctgcacattattctccctgtcttccatttagcccgttagtttgctgacagtagagtacacagcacttagcagctggtttgtggagccatcagtcaggaaattgtatgataaataggaggtagccaggtttcgtggcacttccttctgcttcagcagttttcgcctgactttggagaagtcatcatgtggtgttttgtcaaggggcagggcaggagatggctgcggtgcagtaacttattacatatacgcttgagttatgatgcgtcacagctgcactgctcatgtgtaaataataaactgcgagctgggta

SEQ ID NO: 404486 - DNA, 479 bp, Homo sapiens
tcttgctcaatttgtttatttgttttggtttttttctttagcaaaaatactttgggccttcttagatgtggaaaacttgcccctgggcagagccaaggaaaatcaaggggaaagaaaaaattgaattgctctacaaaaggaagttggaaaattttaagtatttaggaattgcccaggaggggacacgggaaggaggagcatgagcaaggttctggaacaaggtgatgcacagaggggccaggcaatttggcaggtgaaaggttctctgtgataataatggcctgtgatttttaagaatagaaatgtttaaaatgttatctgccttgctgtaatgtaatcctttgttattccatatttattgttgctgttgttaaaatctattactcacactctcttgcatgtggtatttataagaaattgaagaaaaaaacagggaggcaagagcattgccctgaattattggaaacattagtatgaag

SEQ ID NO: 404487 - DNA, 1052 bp, Homo sapiens
tgctggaggtaacaggctataaccgtggatgagagatcaccaccttaaagaaaaaagaagcgatatttagagtcattcagcagataaaagagaaaggcttcaacacgtggagataagggcttcatgacagtatttgttcgggatgtagcaggccgtgctacacgagcaatcatcgaagactcgaccaggaggcctgctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaacta

SEQ ID NO: 404488 - DNA, 11371 bp, Homo sapiens
  misc_feature (3872)..(3872): n is a, c, g, or t
  misc_feature (4285)..(4285): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtagaatccatacagaatgtcctggtgatgctgccaacaatctgcnagtgcccagctgccttttgaggccaaccctctaggttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatca

SEQ ID NO: 404489 - DNA, 10500 bp, Homo sapiens
  misc_feature (3872)..(3872): n is a, c, g, or t
  misc_feature (4285)..(4285): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtagaatccatacagaatgtcctggtgatgctgccaacaatctgcnagtgcccagctgccttttgaggccaaccctctaggttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttctgtcatgcttatttcaaactccctgagtgatgggtaagaaatcaaacattgcctcagtggtatcaagagaactttggtggtggtttcttacccatcactcagggagttt

SEQ ID NO: 404490 - DNA, 2853 bp, Homo sapiens
ccctgtccagcgccccaccgaccggaggtgaccggaccgactagcacctctaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatca

SEQ ID NO: 404491 - DNA, 10190 bp, Homo sapiens
  misc_feature (3872)..(3872): n is a, c, g, or t
  misc_feature (4285)..(4285): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtagaatccatacagaatgtcctggtgatgctgccaacaatctgcnagtgcccagctgccttttgaggccaaccctctaggttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaacta

SEQ ID NO: 404492 - DNA, 2257 bp, Homo sapiens
cttttaaaatgtgtttgcatgggtatgtgtgtgtatgattcctgtgtccttcattgtgtctgaatgttgacagctgagttgttgtcctgtgggtgtagtatagtgtgttcttaaacatttcaggtatttttgaatttatctatgttgtctttgaatcttttacagggattctataactgccgtcatgtaagttgttacagaagggaggctgtttttgtgtcttgtatatttcttttctttcagaaattacagatgtttataattagcttcaaacactgccttaatagcaattggaagataactgccgtcagccgacgtggtctttccctttacttcaggaggagaatgactactaatctggaagaaaggtcttactatagcagtcagatcaccagagtagtgccgaacacttcctggcttcatctgaaaatttgagtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatca

SEQ ID NO: 404493 - DNA, 1883 bp, Homo sapiens
ttaatcaaagctctagtgtattattagcaaacacttaaaaaatatgtaaataccagtactgtggaaaataattagatgacacataaactggatttaaaatccatctcatctgcctagattttatgtaagtgatataatgaaggtgccttaaaatatttgatactttcaaatgtttctcatgttattttcttattttctaaaaaagatgtattcactaaattatatacactcatataataattaaatataaaatacattcttttattgtgtacctttctatctagaaggtagcacattattacagtgtttcctgctggtcaaagttgcctattagagaaatagaatggtaattttaatatattcacaaaataccttattgatatcatcaaaccaatttatacattgagtttgtaccaactagtggaattgtcttaggtctattaagttatggaatattatatccataattacagtctgagtcatagctgaaaaaatctgctttaaaattattctcactctttgaacatttcataatcttacatgttttcaagcaatttgccatactctactaacctttgtgcttcttttttcctttgccatgcttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaaggagtgtgaatttgttgttctatccccaaatcatatagattgaactgctattataaaaacagtcatggcctctcatggaagagtagatagtaaaataatcgttttgtttcacatattttttgtgaaacaatgaacaaagttggttttaatagtcattatattcacttattaatttgtatatgcatctactatatttctattatgaattcagaatatttggaaacttctatcgtaaacataactatatatattttttctgtgtaatattagggaaaatgttacatatatctctgaaagatccattagtaaatctattttatgttttgtgtaataaaggtttttaaaaaaatttcaacatagatgaaactgtcctatttctctaacatatcagacgtactttaaaaaattctctaaaaagtatatgatctttggtagttagaatgtttaatccctatgactgctgtgcttttggatcaacaaaggaatatttatcttgactacagcagaagctcagtataagcaacaggtgatttaatttaactgattcagcacatgatttctgagtctcctctaattcttaggtttatcaagttttatttctataaatcattctctatgttttttgaaagtgactactttaaatttgaaaatattgagattactgcaaa

SEQ ID NO: 404494 - DNA, 322 bp, Homo sapiens
acttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcaggggataaaaag

SEQ ID NO: 404495 - DNA, 267 bp, Homo sapiens
gttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaa

SEQ ID NO: 404496 - DNA, 11290 bp, Homo sapiens
  misc_feature (3872)..(3872): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccaggtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatca

SEQ ID NO: 404497 - DNA, 730 bp, Homo sapiens
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcg

SEQ ID NO: 404498 - DNA, 10743 bp, Homo sapiens
  misc_feature (3872)..(3872): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaaggagtgtgaatttgttgttctatccccaaatcatatagattgaactgctattataaaaacagtcatggcctctcatggaagagtagatagtaaaataatcgttttgtttcacatattttttgtgaaacaatgaacaaagttggttttaatagtcattatattcacttattaatttgtatatgcatctactatatttctattatgaattcagaatatttggaaacttctatcgtaaacataactatatatattttttctgtgtaatattagggaaaatgttacatatatctctgaaagatccattagtaaatctattttatgttttgtgtaataaaggtttttaaaaaaatttcaacatagatgaaactgtcctatttctctaacatatcagacgtactttaaaaaattctctaaaaagtatatgatctttggtagttagaatgtttaatccctatgactgctgtgcttttggatcaacaaaggaatatttatcttgactacagcagaagctcagtataagcaacaggtgatttaatttaactgattcagcacatgatttctgagtctcctctaattcttaggtttatcaagttttatttctataaatcattctctatgttttttgaaagtgactactttaaatttgaaaatattgagattactgcaaa

SEQ ID NO: 404499 - DNA, 11423 bp, Homo sapiens
  misc_feature (3872)..(3872): n is a, c, g, or t
  misc_feature (4285)..(4285): n is a, c, g, or t
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcagacaactgatcaatactgggttccatgtttacatgatgaaactgagaaactggttcgtaagttaatccgattggataacctgtttgcctattggaatgtgaagtctcagatgttttatcttagtgattatgataactccttggacgacttgaagaatggcattgtcaatgaaaatattgttccagaaggttatgattttgtatttcgtcccatatctgctaatgccaaacttgtgatgaatcgccgatctgattttgacttttctgcccccaaaataaacttggaaattgagttacataacatagcaattgaatttaataaaccacagtatttcagtattatggagcttcttgaatcagttgatatgatggcacaaaatctgccatataggaagttcaaacctgatgtgcctcttcaccaccatgccagagaatggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggagttggaaaaaaccttggatgtctttaatataactatagctagacagacggcagaagttgaggtaaagaaagctggatacaaaatttacaaagaaggagtaaaagatccagaggataataaagggtggtttagctggctatggtcttggtcagaacaaaatactaatgaacagcaaccagatgttcaacctgaaactcttgaagaaatgttgacacctgaagaaaaagctttactctatgaagcaattggctatagtgaaacagcagttgatccaactttactaaaaacatttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaaatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcaaggacagtgaatagtatagtggaattcttcagacctccaaaagaggtacatctagcacagctcactgcagcaactttgacaaaactggaagaatttcgcagtaagacagcaacaggtctactgtatattattgaaacacagaaagttcttgatctcaaaattaatttgaaggcttcatatattattgtcccacaagatggaatttttagtcctacatcaaatctgcttcttttggaccttggtcatctaaaggtgacgagtaaaagtcgttctgaattaccagatgtgaaacaaggtgaggccaatcttaaagagataatggatagagcttatgattcatttgatattcaacttacaagtgtacagctgctttacagtagagttggtgataattggagagaagcacgaaaactcagtgtatctacccagcatattttggtacccatgcacttcaatttggaactgtctaaggccatggttttcatggatgtaaggatgcccaaattcaagatttatggaaagttacctcttatttctttacgaatctcagataaaaaactacaagggattatggaattgattgaaagcattccaaaacctgaaccagtaactgaagtatctgcccctgtcaaatcattccagattcaaacatctacttctttgggaacatcacagatttcacagaaaataattcctctcttggaacttccatctgtttctgaagatgattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttggatgaaaacaagaaaccagtttatttggttacaaccctggataacacaatggaagacctgttaacgctggaatatgtaaaggctgaaaagaatgtacccgacttgaaaagtacctataacaatgttttacaattgattaaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattagctttaaaactatccacaaatgaagatatcattactttgcagattttagcagaattatcgtgtttacagatctttattcaagatcagaaatgtaacatttctgaaattaagattgaagggcttgattctgagatgattatgaggccttcagaaactgaaataaacgcaaagctaaggaatataattgttttagattctgatataacagctatatacaaaaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggcttttatagataattttcaggcagctaaacaagccttggctgaggcaactgttcaggcagctggaatggctgctactggtgtaanagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtagaatccatacagaatgtcctggtgatgctgccaacaatctgcnagtgcccagctgccttttgaggccaaccctctaggttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggagcaactgtggtgacagctgctgtggtagaagtacattcacgtgccttactagttaagacaacactaaacataagcttcaaaactgatgatctcaccatggtgctgtatagtccaggtcctaaacaggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcgaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgttttgcagccctgtgacttgttttatcaaactactcagaaaggtacagatccacaagtgatcgatatgtcagtaaaatccctgacactaaaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtgcattattataatgaaatgtttggtgtatgggagcctttgcttgaacccttagaaattgatcagactgaggattttagaccatggaatcttggtatcaagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttacacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcagataagaaatcatttttcagtcccactgtctgtttacgaaggggataccttattgggaactgcctcacctgaaaatgaattcaacataccattaggatcttaccgatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggttcaacttatggtaactgatagtgagttgtccaatcagttttcaattgatactgttggtagtcatggagctgttaaatgtaaaggcctgaaaatggactatcaagttggtgtcactatagacctgagcagttttaacattactagaattgtgacatttacccctttttatatgattaaaaacaaaagcaaataccatatatcagtggctgaagaaggaaatgataaatggctctctcttgatttggagcagtgtatccccttttggcctgagtatgcttctagtaaacttcttattcaagtcgaaaggagtgaagatcctcccaaaaggatatattttaacaagcaggaaaattgtattctattgcgtctagataacgagcttggaggtattatagcagaagtgaatttggccgagcattctacagttattacatttttagattatcatgatggagcagctacattcctcttaataaatcacacaaagaatgaacttgttcaatacaatcaaagttctctcagtgaaatagaagattccctccctcctggtaaagccgtgttttatacatgggctgatccggtgggctctagaaggctgaagtggagatgtagaaaaagccatggtgaagtaacacagaaggatgatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggttcgcctaacccctactggtcataacatgaaaattctgcagccgcatgtaatagctctacgaagaaattatcttccagcattaaaagtggaatataacacatctgcacatcaatcatcatttagaattcagatttacagaatacagatccaaaatcagatacatggtgctgtatttccctttgtgttttatcctgttaaacctccaaagtcggtcaccatggattcagcaccaaagccctttacagatgtcagtattgtcatgagatctgcaggacattcccagatatcacgtattaagtatttcaaagtattgattcaagaaatggatctcaggttagatcttgggtttatctatgctttaacagaccttatgacagaagctgaggtgactgaaaatacagaggttgagctttttcataaagatatagaagctttcaaagaagaatataaaacagcctcattagtagatcaatcacaagtcagcctctatgaatattttcatatatctcctatcaagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagcttgcattttttgaactcaactatcagttccatacaacatccgatctacagtctgaagtcataagacactattcaaaacaggccattaagcagatgtatgtactcattcttggacttgatgttttgggaaatccatttggcttaattagagaattttctgaaggtgtagaagcatttttttatgaaccttaccagggagccatccagggtcctgaagagtttgtggaaggaatggcactaggacttaaggcactagttggtggagctgttggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctggatttgttagtggcataacaggaattgttacaaaaccaatcaaaggagctcaaaaaggaggagcagctggtttctttaaaggtgttgggaaaggtttagtaggagcggtagcaaggccaactggaggcatcatagacatggctagcagtacatttcaggggataaaaagagctacagagacttctgaagtggagagtctgcgacctcctcggttcttcaatgaagatggagttatcagaccgtacaggttgagggatgggactggaaatcaaatgttacaggtcatggaaaatggaagatttgcaaaatacaaatattttacccatgtcatgatcaataagacagatatgctaatgataaccagacgtggtgtattgtttgtaacaaagggaacatttggacaactcacgtgtgagtggcagtatagttttgatgaatttaccaaagagccattcattgttcatgggagaagattgcgcattgaagcaaaggaacgagtgaagtctgtatttcatgccagagagtttggaaaaataattaacttcaagaccccagaggatgccagggtaaatataataaatcttttatttaaataggagctgctcacttcaaaatcattggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaaattgaatca

SEQ ID NO: 404500 - DNA, 1239 bp, Homo sapiens
cgcggccgcgcagccgcctttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggagctgtggccctcaagaatcttcaaattaaagaaaatgccctgagtcaactggatgtaccatttaaagttaaagttggtcacataggtaatcttaaacttataattccatggaaaaacctttatactcaacctgttgaagccgtattggaagaaatttatttacttatagtgccttcttctagaataaaatatgatcctttaaaagaagagaaacaactcatggaagcaaagcaacaggaactgaaaagaatagaagaagcaaaacaaaaagtagttgatcaagaacaacatctgccggaaaaacaggacacttttgcagaaaaattagttacacagatcataaaaaatcttcaggtgaaaatttccagtatccatattcgttatgaagatgatatcacaaatcgggacaaaccgctgtcatttggtatttcccttcaaaatctgagcatgcaggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaa

SEQ ID NO: 404501 - DNA, 503 bp, Homo sapiens
acacagtgtaaatattttgggggtcattttcagtatattaaaaactgcaggaaactcctggcatttagagggcatggtcacaggaccctacacatcctgtaaagtgtgggacagtttcacagaatgaagaattgttctgaatcccacacaaatttcaaaagccccataggacatacatgtagatggaaaccctttctataattatctgaacctaaaactattttctgtataaacacaaagtgtttttgcatggctctcatatatgaatacatggaatagtctagtttgtattctaatgtccacctagcctttaatctccaattttcttgtgatttttaaaaaatcttctgattgtcttctctaaatctaaacatgctttttagtattacatagtttcaagcatttgattatttcattgtgtcttattgtatagttgcatctgaagatttttgtactgaaatagaattttttaaataaattactgtcatttctccattatatta

SEQ ID NO: 404502 - DNA, 321 bp, Homo sapiens
tgcctccaggttcaagctattctcatgccttagccccctgagtatctgggactacaggagagaatggcgtgaacccgggaggcagagcttgcagtgagcagagatcatgccactgcactccagtctgggcaacagagcgagacttcctctcaagaaaaaataaataaataaataaataaataaagcaagaataatccacctgttgtttagcatataatcaagaaataaccataaaaatggtcaaccctcagggctgctctgtctacagaggggctactcttttattcctctactttcttaataaacttgctttcactttcc

SEQ ID NO: 404503 - DNA, 451 bp, Homo sapiens
aaattgtaattttatgcagagactacaaaaaatgtgctagatagcaaatgtatggacactggtaacatttcaaggctattttagtggaaaacgccactctttcacaacaatggagccaaacttcttgactgggcaatcttcatgtaattcacgtagctagagtacagaactccttttggagtttggaaagaactgaaaattaagtatgaggtggaatactggctggactaagtgacatttaaagttctttcttatattttgagattttaaaattatccaagaagatgtttgggaatctatttccacacttagtcatatcctcttctacatcttcaatattctcttccatttatgctccaacacaaaatgatttctctcattttgaggtataaatgtttgaatatccaaaagcatcaactagaatagacaggcaaactttttctgttaaggg

SEQ ID NO: 404504 - DNA, 381 bp, Homo sapiens
tagaaataactcatgttttcacagtatgtactacttaaagaaacaatatagaataagaccattagagttctaattatggctccaccatttgttaacataatcactctacataaattacttaagccatttccccctctgcatattgggattaataaataactcacagttgttgctaagcttaaatgagataacaaagtcattagctcaccatcatttgtatatacagtcattagcaaatatttactgagtaaattctgagggatacagtgctttgcacattataaaaaagtcaatacattttatagcattttgatagtcctagacctagaaagtacttgttggggtcacattgatgccaaatgaaaggaaaagagaaggggg

SEQ ID NO: 404505 - DNA, 362 bp, Homo sapiens
atcattagttcatactttggttcccaatctgttatcaccaagaatcccttaaaagtcttttctctctataaagtggacactgtcttgaaaaatcatatctgtaagacaatgtgtgttatcaattgtttttttccttatcattgatcaaaaaaatctacattgcctattggtcttttaattcagcatgagagatccctttagggttggacctaggccacaaatgcaaaggattactggtcaaagctgaaggtccaagagagacatacagaagctgctctcatgccctccgacaccttacgtggccgctgtttacatactgaccactctgcatatttgaagatacctacctgcgcaactcctct

SEQ ID NO: 404506 - DNA, 159 bp, Homo sapiens
aacccagcctggagaatttgagaccttttggccaatctgatgtctaaaccacccaggatgagtacaattcattgcagcagagttgggaaagggcctttcccaagtagcagaaacaagattttcaaagactcataggtcaggaagacctcgcaacgtgat

SEQ ID NO: 404507 - DNA, 276 bp, Homo sapiens
ctggataagcatccatctgtatagccttttatgtatggcaaaaattgttttcatttcttgatcagaatactgttctgatgtggtgtagtcagccacctgaagctgatctagcatgggcagcctaggcaggtagggcgaatgactgtaggagccctgctaaacccgagtctctactccagagaggagttaaaaaaagctgaacaagcctgaacacggaggagccactattgctgtcaaagttaagtgaagcagcttggcttatgtctatttcagaat

SEQ ID NO: 404508 - DNA, 363 bp, Homo sapiens
  misc_feature (323)..(323): n is a, c, g, or t
ttcagagttttatttaggacatattcagtttgaaatgtctgtgagacaactaagtggaggtggcatagagtcagaaatgtgagtctggaatttaaagagatctggactagtcatacaaattttatgctcagtcacatcagcataaaaatgacattaaattgcatgggaatcagctcactcaggcagtggttgggagacgaaagaaaagcagtccgctaaggaagctgagaaagagagggatagcattaggagaaatacctaatgtaaatgacgagttaatgggtgcagcacaccaacatggcacgtgtatacatatgtaaacnctacgttgtgcacatgtaccctagaacttaaagtataatt

SEQ ID NO: 404509 - DNA, 220 bp, Homo sapiens
ttctctgttaccgccatctaacaatcacataagtgaaaaatctgtttgtcactctagatacctccctatcactttatccttacatcgaagtcaagagatttaccttccttatatctctcatacccatcagctcacttctcttcctactgctaatgctttgggaccactaacacattttgccacagacacaacctccttgctggtctctgtgaatctggta

SEQ ID NO: 404510 - DNA, 423 bp, Homo sapiens
gctccctcaacttcaggagagtggattgtggatggtgtgtccagagtctcccgggagggaagatgacccgagaggattttagaaagcacatgttgcagaagtggtctccatgaagaagcgggacggggacgaggcatccccataaactggtgaagctggatgtctaaaggtcttgcactggctgttggggggagaaggggtacctcaactgggtgaaggcacatcacctgcctgaatacagaagccaggtggtggtgccggaagacaagtgttcccaagaccaaaacttggaatagaatgaggctcttgaaaaatgctgaaggggtaggagcagaaaaagcagcttttacctagaaagatcagttcagagggaaaaggacaaccggggagaatcagcaccttgccgggggacatggtgaggtg

SEQ ID NO: 404511 - DNA, 559 bp, Homo sapiens
ctgggattacaggtgtaagccaccgtgcccgaactatattcatctttattattagtattcccatggttttactacattattactgcaaataatctttttttatttgtcagtcatcttcctttgatattccatgttcagtaccctacagaggtaattttgctcacattctgtttgtctaaaagtgaaaaatataggattttagaatttagtaaaattagtgtaactgtcaagtaaacttatcatatatttgtggtagttgtttttaccaccatggtagaacctgtaaatactgacgagtgtcacccctcttgattctgagattttttttgtaacatacttttttaagatgaggattgttgaggtatatttacataaagtgaaatttatccttttaaaatgtatagttggtccagacatggtagtgtgcatgtcatcctagttacttgggaggctgaggagggaggatcgcttagctcagaagatctgggctacagtgagctatgattgtgccaccgcactccagctttggcaacagagcaagactctgtctcaaataaaa

SEQ ID NO: 404512 - DNA, 366 bp, Homo sapiens
catagtagcgttcttctgtcactagtctggcacgttataggtttgcgtcattctcttctcttgttatcagaactggctgcctttatttcttggtctgtgtaccttccagttactctagttttatgtcataaatttgaggcttgtggagaaagcctggccccttcatccgatctcagataggccttatctatttaatacaattgttaattacttccttgccttactaaactgacttacctacctggcctcaatgtcatggtcttactttacccttctagtaagggtcttgctggtccacttttggccagctaactctctgctgcaagagaacagctgctctagagcaacacggctgaaataagaaga

SEQ ID NO: 404513 - DNA, 291 bp, Homo sapiens
ctgtgggaggtgagcagtaactcaactgccacatgaataagtcacaaatgaccaatggtggtgagcattccaaggaggcagaaggaacaggatgttaggagaaggaaccacagtgaaagctgctccaaggcacatgtgagagctccatcctggagggtgagctggggagaacaagggagagtactgggaagcatctccagctgcaggaatagagcgtgcaaaggccccgagttgggcatgtgatgggtgtgttccagaagggagcagggcggctgggacggagtgaggtga

SEQ ID NO: 404514 - DNA, 612 bp, Homo sapiens
aagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttataccttccatttccatcgtattctccagtttccaggatagacgttgctcatcgtctttacctaataaataagtttgtctgattgctgaaagcaacct

SEQ ID NO: 404515 - DNA, 353 bp, Homo sapiens
agctggcgaaggtcggccgcgctccgatccccaagagctcccgcgggctgggcgcgggacgccgggctcggccttagcccccgggatttagagcatcctcgcgaccacccggaggcttctgggggccactctgcggatgaggaagctgacgcctgggtgcagaaccccggacccccggattcagagcccaggtccagccgcgcttccgcacaaacttgcgctcggagcaagtcccctccttcccagcactcatctgagaccagaggtgtccccaccgtccccgctagcagcgctggttatattgtgggccaacctttaaaaaaataaaaaggaactgttaaaccacaatgctt

SEQ ID NO: 404516 - DNA, 411 bp, Homo sapiens
cttacacctcagtagtacttagattctgctgataagtctaaagttaaatgatcttttatggtagtagaacagtaacagtatccgttataatgttttctccaagaagatatttgtttattcatttttatcaataataataagatagctaatgttacacttgattttacattcaggtggtctgtcttttaaagaagttcttatctttatttctctttctctttcatttattataatccctattagtaaacttttaagtctgcagagaagttttgggaagcatttggaagtagtaggtgatgtactactgagcgtgaggtgaggaacatattagtgcctctatatttttatttggggtagagatgagaccagaaaccactgtttttgtacattggatttgaatatgaaggtgtg

SEQ ID NO: 404517 - DNA, 377 bp, Homo sapiens
aaaggcgaaggatcatacactgggagtcgaacatcaccagtatccagtgattactcgtgggcaccaatgaagatatttgtttattcatttttatcaataataataagatagctaatgttacacttgattttacattcaggtggtctgtcttttaaagaagttcttatctttatttctctttctctttcatttattataatccctattagtaaacttttaagtctgcagagaagttttgggaagcatttggaagtagtaggtgatgtactactgagcgtgaggtgaggaacatattagtgcctctatatttttatttggggtagagatgagaccagaaaccactgtttttgtacattggatttgaatatgaaggtgtg

SEQ ID NO: 404518 - DNA, 543 bp, Homo sapiens
atataatatggcataaaaactataagtaggccacacattgtggttcacacctgtaatcctagcactttgggaagccaaggtgggcagataggttgagtccaggagttcaagaccagccttggcaacatgataaaatcccatctctataaaaaattttaaaaattagctaggcatggtggcatgcaccaatagttccagctacatgggaggctgaggtaggaggactacttgagcctgggaggcaaaggtcgcagtgggccatgattgtgccaccacactccagccagggcaacagagcaagcaagatcctatcaatcccaacactttgggaagctgaggcaggaggattgctagaggccaggagtttgagattgtcctgggcaacacagtgagaccccattttaacaaataattagccaggcatgccaggtgcggtggctcacgcctgtaatcccagcactttgggaggccaaggcgggtgaatcacctaaggtcgggagttcgacaccagcctgaccaacatggagaaaccccgtctctact

SEQ ID NO: 404519 - DNA, 696 bp, Homo sapiens
cagtaatcagaagttgttttgaatgaaatgttttaaatatttttggacaaacgtcaaatgggaaagtattagttgcccctttggtcatttgtatttaatagttgtatgcaaaaagaagttggaatcaatgaaatggtgacataatacaggcaaccttccctttttgaggattaagttgaaaatagtgaaggtcactttccattctgtaaacaaaaggggcagatttggctagaagaatactacctaccatttttcattgattctgatatgtccattttttcacatttctgaaatttgggtacatcctgaaattggtagcatattttagttgaaactatttttttctagcttgggagcacataaaataatggtgtgtgttacgatcaattatagagtcttagatcaatgaaatgggatttttgaaggtaagaggtagatgagaattccctcagacctgggcccgacttcatatctttctggttctgctgtgttggcaaaaccactggagcaaaaacatggtggcagtttgccttcactggccctgagtatgacaaaaagttgttcacttgttgtagtcaacccattgtagcacctttcataagttaaggagggtgatcttttatcagatacctttgtgactgcttgaatatgctgagaatatatcatgattatttcagcaacactgaactttctccc

SEQ ID NO: 404520 - DNA, 729 bp, Homo sapiens
tccatttgggcattgctcagctcccccacctgttaatagcaaacaccaatctcaagcccctgccccaatctgctacaaggggttagtgttccatgcagtgggagtgcagggaaggctttacaggagaggagggagttgaaatgggcctggaggcctgggatggtagacactggatccttttcccccacagctcctggctgtttcttcacactcccagcatcactattactgctagcatgtctttagcatcattttgccctccctctgactttcagcaagcctgcacttacctccaaataaatgcatgttttcggggggcaaaggcaggttccttccttaccttattgttgcttcccccaccccatgctgcagctgagtgggtgacctttctcctcacctccgtgtgccgcatctctcacctagtctctgttaggaaccctacaggagcctgcaccccagtaaccccattttatgctgcttggaggaagagacagagagtttgagaggtcccagttcttttcagtgtgtgtttggttcccccacttctcaaagctgagagcttctttgttttaagagccacttggttaagtcaagagcattagaagagtaaaaagaagaatacaattagataattttacctaaacatgctatagtcgactagggagtcacatagacattgattttctaatgagggcgctgttggtgattctttttgtgtgtaaagatgct

SEQ ID NO: 404521 - DNA, 195 bp, Homo sapiens
agaaaagggagaagtatcaggttgtgaaggcatgctgagtgtcagaaatgaactctacttctggctattctagttccttgagacaataaatttcttctttttttttttttttggctgagtttgtgttgggttttctgttctttgagattgatagggtcctaactggtatagaaatgataataattgttgttgaag

SEQ ID NO: 404522 - DNA, 182 bp, Homo sapiens
gctttcaggtagacaccattttttgtaaaaagttttaagaaaccatgtatcaaattgcattataattttatgcaccaaaccaaaagatagatactgtcataatactaaatgcgatagagagctgcctaagatggccagctcaatgaatcttgggcatcacccacacaccactgaaaattctg

SEQ ID NO: 404523 - DNA, 781 bp, Homo sapiens
caatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgcactatgcagctgctaacggtagctaccagtgtgcagtaacattggtgactgctggggcaggtgtcaacgaggccgactgtaaaggctgctctcccctccactacgctgccgcttctgacacttacaggagagcggaaccccatacaccttccagccatgatgccgaagaggacgagccactgaaggagtcccgcaggaaggaggccttcttctgtctggagttcttactggataacggtgcagacccctccctgcgggacaggcagggctacacagctgtgcactatgcagccgcctatggcaacagacagaacctcgaactgctcttagaaatgtcctttaactgcctggaggatgtggagagcaccattccagtcagccctttgcacttagctgcctacaacggtcactgtgaagccttgaagacgctggcggagacgctggtgaatctggacgtaagggaccacaagggccggaccgcactcttcctggccacggagcgcggctctactgagtgtgtggaggtgcttacagcccacggcgcctctgccctcatcaaggagcgcaagcgcaagtggacacccctgcacgctgctggttagtgcccactttag

SEQ ID NO: 404524 - DNA, 493 bp, Homo sapiens
aagagaaagaaggaaggcatctatgaacagccaaagttatttctgcttttgggtttagagcatatgccatgcagaatttttaaaagcaagcagataaaggcctatggagctcactggaagagtgagacatgttatatggtagtttgcattacaggtgaaccaatctctttagagtacccaacaccagaagtttcatgaaaaagaaagtagcataacttatgtgtaggttttacggacataaacttcccaaagttcagatccccacaagatgatcttacataaattacttaacatcttccttattcattaaataaggatacagtttgtatagtaaatgaaagtatatttgttaagcactaagcacactgcctaggacacacctgaaatactaaaaaaaatggtgaccaccttatttccctcttctattttttttctaagactagtaaagtgcagcagtgagaagggaggaaaagtagaacaaggagttctatct

SEQ ID NO: 404525 - DNA, 224 bp, Homo sapiens
gtgagtctggtggcacaattccctccgatttcagacaacttctttccaccatttcacaatatcacacaaactgcccccttccgacacccacttccacacccacttccacatcaatctcaagtattctttaaccacgggacatcagtaaaactgtgcttctgtctttcttcgatttgtatctttggttttacgcattcctgacagcgtttcagtgttatgtcact

SEQ ID NO: 404526 - DNA, 523 bp, Homo sapiens
tcttcttcctcgggtttcaagtatttcccttcttcatgttgttccacctctcttgttacgaaattccaccttccaggcctctttccaaagaggaaactttgaagtcctcactgttttcggactcccacccctttgtgccccttggctaatgctgaccttccctcctaacacctcccctgtgatggatgtggcttcctcagggtaaactggactttcgctgtgccttggcttccttcgcttctctttttccttattcttaggttctcccaaagtgctgggattacaggtacgaggcactgagcccggccagtggaaccactttctatagtgtgcccatactgggccttggacatctttcctagtttggtacctgctgtttacttaacagcatgctactgtgtatctgtgccatcttgtcacacttgtctttgtaatgttgcctaactctggctctccagatttgtacattacgactttattgtaaatcagagaaggtcaataaatttacttctttcaaatttcc

SEQ ID NO: 404527 - DNA, 399 bp, Homo sapiens
agatgctgacagatagtgggtacctaataaataattgtccaattaactgacttagatatgagtatgctgagtatggtaatagaattgtaggttctttcatggcttgggggattgtttgaataattctgtcagccaaaaagaaaagaagtgctgggattacaggtacgaggcactgagcccggccagtggaaccactttctatagtgtgcccatactgggccttggacatctttcctagtttggtacctgctgtttacttaacagcatgctactgtgtatctgtgccatcttgtcacacttgtctttgtaatgttgcctaactctggctctccagatttgtacattacgactttattgtaaatcagagaaggtcaataaatttacttctttcaaatttcc

SEQ ID NO: 404528 - DNA, 525 bp, Homo sapiens
ggagattgtcagaagcttaggaaattttatgttcacaaaatagcttacacacacacatacacactagtaagccatcccaggatgcaccttagttatcatgctacttaaacagctacagtcatgtagatcatctgggtgttggaaacattgagggcaagaatatgaacaagtacatcacaaatctgagattggacctgatagctgtgtcttagagagaattcccatcctgtctgtctcctctcatgtccattcttgtatgggacagacaaatttaaaattccagatggtgccatttgttatgggacctttagtactctttgggtggtaaggtatgctaaatcatttattaccatgaaataaagtacttatattcaccctacaagtgggctctgtctttcttagctattacagtgcagtaatcaaaagatgagtttgccagatgaaattagcagattgagcaggagaaaggcagtgaagttgcaattgagctacagggttcctattttggtattagaagcaaatttt

SEQ ID NO: 404529 - DNA, 191 bp, Homo sapiens
tctgatggttttatcaggggtttctgattttgcattttcctcattctctcttcgcctgctgccatccacggaagacaggacttgctcctccttgccttccgcgatgaagattgtgaggcttccccagccgcatggaactgtaagtccaattaaacctctttcttttgtaagttgcccagtcttagggatgt

SEQ ID NO: 404530 - DNA, 554 bp, Homo sapiens
taacagaacattttggggggaaagctaatctttttggcagtgctgctcaattggtggaaaggaatgactgagcttttcttaggaacaggttagtgcagtgaaactggttaacttacagtattttgggttcctctcagaaaggaggagggggctaatgcaaaataaagagaagggcttgaaatccatctccatgcctcctggagcacagccaagttcagaaaactctatattgtctcaacttattattattattttttaaattcagatatttattatgcatcctctgtgttcccaacacaccattctagccactgggggtacagcattaaaggaagtaggcaacagccttgccctaatggagctcacattcttatgggggacaagataaattttaaaatatgttgtatgttaagtagaaaaccaaagcagaggagggtgattggtgtttgggtgtgagtgtgtgtgtgttgtatgtttgcatatgttgggggtgagatacagattgtaaaaagtggtcaggaagggaatggtttcttttctggttctgaaccctc

SEQ ID NO: 404531 - DNA, 417 bp, Homo sapiens
gtttagaaaggccaagtttcttaatttccagttcccttctttctctacaccacactgtcttctttcttctttgtaccatttgcctgctacatttagagttatgcaaatagccttattactgaaattagaaagtttaaaagttgctgccagaagttgaaacattttcatggaatcccctattgccaatacatgtgattaattttgctcatttaagtttttggtatagtgtttcaggattggcttaacgaatttctccatttggcctactatctgaagaaaatgagtaaacacagaattccttctgtattggcagttttgttgcagttttaactggacataaatcaaaattaccacagtgtctccaaaggcaagtttataccagcatactagtaattataattattgaagtctgttcca

SEQ ID NO: 404532 - DNA, 345 bp, Homo sapiens
ctctctgggcctctatgttcgcatatgcaaaaatggggataattataacaaggctgttgtgaggactaattagtgagtacagtgcctggtgcagcgtaagcactcactaaatgtcaattaatatcatcatcaccaaatgtctggtttgctttttgtctcaggaaagggcctagaacaaatcatcctgcagcccacggggtctggctctgcccaccgccccttcttcctgcagctcctctcccggcctgggaacttcttcctgctgagccaccgcagtggctttcctgctgccctctagtgaccacatcctgcggtgcagcctcgtagtcccgtcatcgctgctgt

SEQ ID NO: 404533 - DNA, 311 bp, Homo sapiens
gaacaaatcactgaagttaatagcatacttttgtatttaaaaaattaacttaagtgcttgctttggcagcatatatactaaatttggattatgatttatatgtaataaaactcactcatgagtttagccaaatatatacagtgttataaccaccatacaatcaagataagaacatttcccatagcacaaaaactttcctcatacattcttagatcaaaagcctgcccctactcacactgatcctccttctcaccctaaagattacttttgtctgggttccttttgctattgaaacttctaaaactaggggg

SEQ ID NO: 404534 - DNA, 338 bp, Homo sapiens
tgaatctatagatgtggaatccatggatgaggagggccaaccatattttcctctgtatgacactggtatactttatatacaagaataatagaaattaagttcggtggttgtctgaacagttaagagtttgaactagataatttctatgttcaaacactgattcagcaggtctttagccgtacctgctatgtgccagaccctggtctaggtgctaggaatgtgagaagcctttggaggggacgcagagccgtcatagatctactcgggaagttgtgaaagacttcttagagaaagtagcattagagccaggccttggagagggtaggatctctgttggc

SEQ ID NO: 404535 - DNA, 748 bp, Homo sapiens
gcgctgtgtgctttgttgtgcgctgtgttctacgtgctctgtgctgtgcgctgtgctgtgtgctgagctgtgctggcatcgttctcactcctcctggtggctgtgggaggatggactgtttaagaagagatgtgtaccattggcagtgagctgagattgtgccattgcactccagcctggacaacaagagtgaaactccatctcaaaacaaaacaaaaaagaaatgaagatgaaaaaaatcaaggcccatggcccagttgaaactcttttgaatgaagtggaggaggcaggatctgtgtgatttgagagtccaggctctgagtcaggactgcctcccggcaacacacaacagcaacaaacacagagtgcaatcttagggaaatgccaagaccttcaccttgagcgtgtgcatgcgctgctctacagaacccaggaggcgccttccgcccacccacagcatcacttcactgaacatggagttgggaagagacctgcgcaatcggttctttctgttggcaggcgcctcccccagcacacctctggatagttccccgtcttcagagaagagcttcctgcaattataccgtagtatctgcagcagcatcaccaaaatgtggccatactggaatccctgaggcggagcagctggacccgagggctcactgattgtgcggttgggagcgggcgtctcgcaggcttgcagagatcagcttttgttgcgccaggagctgatgcttaatggccaagc

SEQ ID NO: 404536 - DNA, 358 bp, Homo sapiens
taataaattgatattcttaaaaggaacttaagcagttaccccaggtgtccacattcttgaaatatatcattttcttaaaagttacaagaaaaccattgatggttcctagcaagctcctaactctgttgcataaagaaattcttattcccaagggccctttgatttctacagttaaaagatattcagtaatacaaccactgagttctgaaatggcatatgttccaagtacaggggaatcaacagtaagaataaaataaagattcttccatccaactaagagaaataccctgcatggtgagaaattccagatgaactctgcattgatcccattggttagcatttggtaaatgtttgtcag

SEQ ID NO: 404537 - DNA, 368 bp, Homo sapiens
actctactaaaaatacaaaaattagctgggcttggtggtgcatgcctgtaatcccagctactcaggaggatgaggcaggagaatcacttgaacccgggaggcagaggttgcagtgagccaagatcacgccactgcactccagcctgggatgacagagcaaaactccgtctcaaaacaaaacaaacaaacaaaaaagtgataaagagatcatgaaggcagacagagacacgaaggtgggactggcagtaggatgctcatcagtaaccaaataaggcacagtaaaacatgcttaaactcctgggagaaaaatatcaacgcaggattctctttctagcaaaaatacctcagaaaccaacctaggcaagatg

SEQ ID NO: 404538 - DNA, 253 bp, Homo sapiens
gatacgctcttcgaagtccgcagaagacttaactgatggttcatatgatgatgttctaaatgctgaacaacttcagaaactcctttacctgctggagtcaactgaggatcctgtaattattgaaagagctttgattactttgggtaacaatgcagccttttcagttaaccaagctattattcgtgaattgggtggtattccaattgttgcaaacaaaatcaaccattccaaccagagtattaaagacaaagct

SEQ ID NO: 404539 - DNA, 294 bp, Homo sapiens
gtggggtggggtacaaataatgtgctgtggtgtcagatgtttgcaggcatctcagcagagaaaggttcccggtcctgatccatctcccactgcaactctatgtatctttacagtcatcccgtttatctggtatagtgaacatggcccagggtgggggtacaggtgagcctttttctgttttgtttttgtttttctgagccatttttgccccaaggaagagtgagtgttagaagtatcaaagggtgataaatgcttacaaatgccaagcaagaggtaagtaataataatctgtca

SEQ ID NO: 404540 - DNA, 346 bp, Homo sapiens
gctggtgaatggatttgatgcaatggaagacaatttattgtttctcacattcactcaagggttcactgtgactgtttataatcaagttttattcagtattattctcttcagcagagaatcagaaaactggcctttggagagttgcttaagcatgattgatagcattgggaatcagaaaacaataccccaaaatgaaggtctcagaagcaaaagtttttctctgacctctcctgccctcctgcccctcggtcccattctcccaaggaagggagccttacaaatttgaatcttccccaaagctggtcatagaaaccaaaacccctttaaaacctcaaaatattactgg

SEQ ID NO: 404541 - DNA, 266 bp, Homo sapiens
ttaaggatacctagtaaaggctaaaatcagagggctgagtgtgttggctcacacctgtaatcccagcactttggtctcaaacccctgatcccaagtgatccgtcctcctcagcctcccaaagtgtggggattacaggctgaggcaccctgcccagactgtataatcctagcactttgggaagctgaggtgggaggatcgcttgaagccaggagtttgagaccagcctgggcaacaaagtgagactcccgtctctaccaaaaaaaaa

SEQ ID NO: 404542 - DNA, 362 bp, Homo sapiens
taaatccactattagccaggatggtagaaaaagaagtacaaaatccccaaagtatgataaagttgtccaatctctggagcccgatcttaaacactagaaatctataaaactattcataagctttaataaaataattttgaattacaatgcaaaataatttttggcttatcttaaatcctttgtgaaaaaggtcagtgaggcagggttaactgtatacataaatacatgcataaatacctacctctaaatttattattttgtaatttattatgtttgtataatttttgttttttgagatggggtctcttgtcacccaggctgaatacagtgccatgatcaaagctcactgcagccttgacctc

SEQ ID NO: 404543 - DNA, 541 bp, Homo sapiens
tttatacactgagccagaagctttggaattattactactctggcttagagaacatatttataaatattcttttggggaaataacctttcctgtctttaaaataaggtaggcccactgcaaataattccataagtaacctttcctatgccacccatgggcattgggcagtagagcctcaaaatccagttaatatttaaagaggacagtctgaatatagggaatcatgaaactatctctctatgcttggagagatttttaatttgacaatgtaaataggaagtaatatttagagagatactttaacaaagagataacagaaaatctacaagttccatcttaatgagaaattggtatttctaaagacgtgagaagacatctgcttctgatcaagatgaactaacaggggctgcatttaccgggtcaccaaaaataacaaacaaaatataaaatgggtgggcacagtgattcacacctgtaatcccagcactctggaaggccgaggtgggatgattgcctgagcccaggagttccagaccagcct

SEQ ID NO: 404544 - DNA, 938 bp, Homo sapiens
caatgtagctcatgttggaaaagcagtcagggaagtactttaagagtatatcctagtactccttagcctgaagcctctgtaaaagggagcccagataaggcactttgggaaatttgctgcaaggctgctggggagaggaagcgccctgcctcactctcagtatagtcaaggctcagcgttttgaataacctctcggtctcaaaacaactgctgtgatttgatccaatgtggtagtagctctctgggtctctaattgggttccccgagctctctcaatgcttagctctttttttctttctgtaaagggagttttcagttaatttgcaggcctgccgttctgtgcccaagagctgaactcttgaggcgtccgcctgggacttggcgggctcactttagttttgttttctgttctctttgtggtggtcttagttataagcgcctggaaacatgcccttaactgcagggcaagtgcttgcttcacaagccctgctagacaggaaaaaggaggaagaaagcacactggggtttatgacatagctacaaactatcctcaatttttaaatagccaaaacctggacacatcctacatacctgtcagcataagaatagattttaaaaattgtgatattcacacaatagaatactactcagcaagaaaaaggagtatgtttctaacacacatcatggataaatctcaaaagcatggtgagcaagataagttagatataaaataaaatgtggagttctagaaaagacaaaatttctggtggtaaaaatcacaatagaaattacctttgaatggtgaagacagacaagacagcatgaggaaggaacttttctagagtggcaaaaatgttctgtatactgattgggagtggtgtttacatgagtataaacatttgacaaaaaagtttaccaggcaaggtggggtgtacttg

SEQ ID NO: 404545 - DNA, 884 bp, Homo sapiens
caatgtagctcatgttggaaaagcagtcagggaagtactttaagagtatatcctagtactccttagcctgaagcctctgtaaaagggagcccagataaggcactttgggaaatttgctgcaaggctgctggggagaggaagcgccctgcctcactctcagtatagtcaaggctcagcgttttgaataacctctcggtctcaaaacaactgctgtgatttgatccaatgtggtagtatttctttctgtaaagggagttttcagttaatttgcaggcctgccgttctgtgcccaagagctgaactcttgaggcgtccgcctgggacttggcgggctcactttagttttgttttctgttctctttgtggtggtcttagttataagcgcctggaaacatgcccttaactgcagggcaagtgcttgcttcacaagccctgctagacaggaaaaaggaggaagaaagcacactggggtttatgacatagctacaaactatcctcaatttttaaatagccaaaacctggacacatcctacatacctgtcagcataagaatagattttaaaaattgtgatattcacacaatagaatactactcagcaagaaaaaggagtatgtttctaacacacatcatggataaatctcaaaagcatggtgagcaagataagttagatataaaataaaatgtggagttctagaaaagacaaaatttctggtggtaaaaatcacaatagaaattacctttgaatggtgaagacagacaagacagcatgaggaaggaacttttctagagtggcaaaaatgttctgtatactgattgggagtggtgtttacatgagtataaacatttgacaaaaaagtttaccaggcaaggtggggtgtacttg

SEQ ID NO: 404546 - DNA, 884 bp, Homo sapiens
caatgtagctcatgttggaaaagcagtcagggaagtactttaagagtatatcctagtactccttagcctgaagcctctgtaaaagggagcccagataaggcactttgggaaatttgctgcaaggctgctggggagaggaagcgccctgcctcactctcagtatagtcaaggctcagcgttttgaataacctctcggtctcaaaacaactgctgtgatttgatccaatgtggtagtagctctctgggtctctaattgggttccccgagctctctcaatgcttagctctttttttctttctgtaaagggagttttcagttaatttgcaggcctgccgttctgtgcccaagagctgaactcttgaggcgtccgcctgggacttggcgggctcactttagttttgttttctgttctctttgtggtggtcttagttataagcgcctggaaacatgcccttaactgcagggcaagtgcttgcttcacaagccctgctagacaggaaaaagtaaatagccaaaacctggacacatcctacatacctgtcagcataagaatagattttaaaaattgtgatattcacacaatagaatactactcagcaagaaaaaggagtatgtttctaacacacatcatggataaatctcaaaagcatggtgagcaagataagttagatataaaataaaatgtggagttctagaaaagacaaaatttctggtggtaaaaatcacaatagaaattacctttgaatggtgaagacagacaagacagcatgaggaaggaacttttctagagtggcaaaaatgttctgtatactgattgggagtggtgtttacatgagtataaacatttgacaaaaaagtttaccaggcaaggtggggtgtacttg

SEQ ID NO: 404547 - DNA, 455 bp, Homo sapiens
ggctcttggctgtagctaaggatagaaaacagctctaatttttgaaattcaggacagagatgattaagaagcatcgatgctcagaggtggttcagaagtacagggatgctgctaggaacatacgctcagacgtgcattttttcagaacatccgtcagtcggccactattacattccacctgtatatgaggagcaaaatggaaacacgtgacctcaagactaatggatggagtctcatggcaagagctgtctaaaggccgcagctgcaaagctacgagactccagcttccggggattctatgaatgtatctacgaatccttacgggacacccaagggcctggcgctgggtctaaagctctgcatctaagctcttgctcagagtcacaggtcaatgtcatcgaacacagcagcacaggccctggtcagcagcagtccagtaaggaagccatggggag

SEQ ID NO: 404548 - DNA, 141 bp, Homo sapiens
ttgtctttgttacctctaggtcccccttcaatttgtattagtttctatttttcacattggaagcttccatccccacagcctgctgattcctagcttgacatttgtatctaagaatgaggagctggttggaagattgcaaag

SEQ ID NO: 404549 - DNA, 435 bp, Homo sapiens
gagatttggatggggtcacagccaaaccatatcactgaggtatcaaggaattctttgctaaagacaaaaaaaaaaaaaatcactgaggttaacactttgaaatacaaaggtgacaaaagaggttagtcttgtcctcagggaataccagttgatataagggagcaaaatcagatagaaagataacttcaagagaataagcttttgaaatgaccatatgaggagcaaaccaatgtttgattactgattagagaaagcagaggttacttctacttggggtcatcatcaaacaagatgatttggaagaggagcaagcatctctttaagccttagagaatgatgggattgttagaagagcttttattttattttgaaatggggtcttactctgtctctccagcctgggcaacaagagcgaaactccatctcaaaaaaaaa

SEQ ID NO: 404550 - DNA, 507 bp, Homo sapiens
atatgttcccagatgtgatccaggaacattccatggaactggaggggcagtgcctggcttttctggccccccctcctctcaacccacatgagccttccccttgtctgggggttggaaagccaataaaggcagagcctgttgtgtaaccacacaccatcccgccaggtctctttcagaactgcagttcagaaacaataactccttgctgttagcatgacttcctggagggatatttccagataaggtggcttgggccagccacacctacttttttttcttctaagtacttttaatttgtatatttgaaccatttatatttaaagtgataattgatgtagttgaattaatatctactatatttgctactgttttctacttattgctcttgttctttctgcctatttttctcttcaactcatttttctgccagttgtgtttttaattgagcatttttaatgatttcattttctcttttcttagtgtagcaattatacttaaaaaaaaaaa

SEQ ID NO: 404551 - DNA, 1019 bp, Homo sapiens
aaaccactcactggctttgtctagcaaagtctgggcagctacgaggatgttttgctgcattttgccctttttatttttaaaattttcatggaaaatggacaaattactgcaaatacttgtggggcaaaagatgggcctcataaattgaataaaactgagaacagagagaactcagtaggcacatcaggcccgcaactctcacctcaaggaatgcttgttggccttggctcggttgactggatgtacagttgcgaagaaaaaacaaaatgaaagaacatgtataaaatactgaaaaacaggccaggtgcggtggctcacgcctataatcccagcactttgggtggtcaagggcagaggattgcttgagcccaggaattcaagaccagtctgggcaacatggtgaaaccctatctctataattgaaaactcagccgggagcagtggtgcacacctgtagtcctagctgctcgggaggctgaagtaggattgaggctccaatgaaccgtgatcgcgccactgcactccagcctaaggagcagagcaagactctgtctcaaaaaaaagaaaaaaaaaaaaaaaaaaaaaaaaaaaaaaaaccaaaaaaaaaaaacaaaggaagaaaaagacaaccacccctacacacgaggaagaaaaagaaaaacaaaatacaaaaaagagggcgagaaaaaagatgacaagaggggaacaagaagggggcaaaaagagaggagcaccaggaaagaccaaagaaaataggaggaaaagaagagacaccaaggaagcagacagaaaaacagagaagggaccaacataaggggagaaaaagaaccagaggggtaagaagagaacgaggcaaaaagaaacagaaaagagagggaaacaccagagagcagaaagagagaaggaagaaaggagagaaatgagccgaaaagaggaggacccagggatgcaaaaaaggggagagaaggaacaggaacgggagcaacacaaataggaaaaatggacacagcgcgggcaag

SEQ ID NO: 404552 - DNA, 333 bp, Homo sapiens
agtggcacaatctcagctcactgcaacctccgcctcccgggttcaagcaattcttttgaattcaagtcttttgaattcttctgagcccagaaaaggtcttttctggaaatgcgttctttcctggacatgaagggggcattctcaattccccagcatacctgggtttttctgagtatcctaatttctgaaagaaatttttctcctcagcttttcttcccaggctttagatggtctatcatatgtctcagccataatctgttggctcaggtagcttcagggtttttgtttactttatgacatttcaagcagttgctgcccttttttttcctcaaa

SEQ ID NO: 404553 - DNA, 423 bp, Homo sapiens
gttaaattgtcacccatgattcggtggagtttgagctgcactctccatagaagactctggaggctgaactggggtcttctgctgggtctgagaaggttcaacctccccaggaaactcagaaggctgagctggctgctgctgcttactggaggaaggttcagctgccacaggaggacctggaggctcagccggagtcccttggtgggttgctgcagatttaatctcctcagggtgctctggtatctgagctggggcctctaattgggttgaggaagagtccacctccttgggtttctctggaggctgagctgtgggtcgttctactcaatttcgaccatacctgtaaccatgcctttgcctagaccgtactcctatttttttcttatttaacaaattatagctaatttttaagccccaggtaaa

SEQ ID NO: 404554 - DNA, 556 bp, Homo sapiens
ccgacttcttacagatgtccggttggtaggaggtacagtgaaaacttataaacaaataaataacaaaattctaggatatatctatttccaacaaaattggaatctttatcttaaatagaccttgaggccgggcacggtggctcacgcctgtaatcccagcactttgggaggctgagactggtggatcacctgaggtcgggagttcgagaccagcctgaccaacatggagaaaccccgtctctactaaaaatgcaaaattagccaggcgtggtggtacatgcctgtaatcccagctactcgggaggctgaagcagaagaatcgcttgaacccaggaggcagaggttgtggtgagctgagatcgcgccactgcactccagcctggcaacagagcaagaatccatctcaaaacaaaacaaaacaaataccatatttttgaaggataaaacaaataccatatttttgccactcagaaaaaaatgatggacattttgtcatataaaaccagacagtaataaccatctgtgggactgtacccaagacccaacaccccttctg

SEQ ID NO: 404555 - DNA, 449 bp, Homo sapiens
tctctctggttgcttgctctgggggaagctggccaccatgctatggggacacttaagtagcccaagagaggcccctacatgggatagaactgaggctccaagctaacagccaggaccaacttgtcagctatgccagtgagccccatggaagtaaatcctctagcctttgttaagcctacagatgactgcagccccagccaacatccgactacaaacacatgagacccgaagccagaagcactcagctgaacaacttccaaatatctgacccacacatagcatgagaatacatgagaaaatacatgattattattgttttaagacaccactctacatctcagggtattttgttataaatcaagagacaatgcagtgctactaatagaggtatgtattttaagtgttctatagactgaactaatgacttataaattgaaatcttgctttct

SEQ ID NO: 404556 - DNA, 469 bp, Homo sapiens
agagcggcgcctactactactatgctggcgaagaagacgacagaagggggcttttttttttcttatttactcactcattaaaatacttttcattactctaacacatgttataaagaaatagttggaaaagtacatcgaaagacttttaaaaatatttggtaactagtaaaaggactaccatcgaaaatcaactcaaaaaattgtccttttatgggttagctgtattataatacatatctatcatttgcccctgtgtcttagaggatataatttgaccagctctacatttaatctgtgtaattatgagactgttttacaacaatcttgatgcagagttggtaggttaagaaatttgtattacagaagttaaaaaaaaaaaaccaaaaactagatttttaggtttattttacaggcattcttatttaacacttaaagattttgatttccagttattaaaatggtagcttta

SEQ ID NO: 404557 - DNA, 426 bp, Homo sapiens
ttgaatctaggctggcttgtgatggttttgaccaatagagtgtgcctgaaatgacactcttctcatgaggtcctaaagatcatgtgtccttaaaccagttctcttggaacactcagtcttagaacattccctctccaaacccagataccatgctgtgaagtccaggccacatggaggtgtcctgtgtagatgctccagctgaaatcccaagctaagctcccaactgacagccaacatcatttccagccatgtgtgggagccatcctggatgtccagccttaacaagccttcagaggacttcagccacagctattatcttactacatccttgtgagactctaataaagaaccaactagctgagcccaatcaacctatggaactgatagaaataaaatgaattgttgttttgtgccgctatgttttgg

SEQ ID NO: 404558 - DNA, 414 bp, Homo sapiens
ataatgtgctttagaaaagaggcctcaatgttaaaatactttcacactttttgagaaaagatctaattagaatatgaaagaaattgccattgcggggaaaatggtctgaaatcacggtaacatttcttttctctctttttaaaaatcagatctttggcgttgccagttccttttaccttttgtgagtttaggtttgatgtgctttggggctttgatcggactttgtgcttgcatttgccgaagcttatatcccaccattgccacgggcattctccatctccttgcagcaatgtgacagggcagttaatacgtgaacatttcagatttataactctttggtccctaaagagacaggaagaagctaaaaggtaagtatgatgacaaaacctacctgcaaggaagatgggtccgacg

SEQ ID NO: 404559 - DNA, 2184 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404560 - DNA, 2182 bp, Homo sapiens
  misc_feature (2146)..(2146): n is a, c, g, or t
  misc_feature (2150)..(2151): n is a, c, g, or t
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaancatnnttggaataatatgaacctccctcccacccct

SEQ ID NO: 404561 - DNA, 2478 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaaaaaaaaaaaaaaaaaaaaaaaaaaaaattgggggggggctacggaccaccgagaaaagttttataacaacacttacggttgggacgcgccgcaccagtgtaaatgaaaacctgcatcaggtgtaccaaggagagactcgggggcagacaactagggcgtgggacttaccaataaaaaaaagcgcggagaccggggctctcgacaacatacaggagtggatcggggctagcggattcacgaggggacggaacgatttagccgaccgagtgaaggaaaacgataagacaagagcacagacacgtcaaaaagtcgacgaagcacagaaaccacaa

SEQ ID NO: 404562 - DNA, 2119 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404563 - DNA, 2130 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaatttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404564 - DNA, 3376 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgggagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaaggtcatttgagagcaccaggatgaaggggggatttttaaaaaatcaaaatacaaatccaactttttgagttttcgttgtcattgctcttatctttcctgagtcacttcccattttccaaactcagcaaccccagtttgcgagtctgttttcatgaacctttgtaaggtgtttggtgcggtcacggtgtatacttgccgtgtagtatttgactcagcgcgatctgccttgagtcattttaccgcggccatttactactgccgttgagccctgtccacgccttgggagtgttgatatgttgagagttttctgtctggctgaggagggatcatttagtttttgcggacgtatgttgcactgaggatttagggagagagcaagatttctgttgaggaggttcagaagtataaggaatcgggagagtagataggagtgaagcatttggcagcgtaaagaagcttggcttagctttaatggattagggagagattgctatctagcattattacatgttattgttctctttgctattttatacacctagaacaacctttccctcggggttaacaaacatcttcaactctgttttctgtatggctcctgactcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404565 - DNA, 2490 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgggagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404566 - DNA, 1557 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccattaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404567 - DNA, 1819 bp, Homo sapiens
tgaagcgggctggaacaggaggatgggcgacgagcagtctgaatgccagaatggataaccgttttgctacagcatttgtaattgcttgtgtgcttagcctcatttccaccatctacatggcagcctccattggcacagacttctgagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404568 - DNA, 2125 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404569 - DNA, 3265 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgggagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaaggtcatttgagagcaccaggatgaaggggggatttttaaaaaatcaaaatacaaatccaactttttgagttttcgttgtcattgctcttatctttcctgagtcacttcccattttccaaactcagcaaccccagtttgcgagtctgttttcatgaacctttgtaaggtgtttggtgcggtcacggtgtatacttgccgtgtagtatttgactcagcgcgatctgccttgagtcattttaccgcggccatttactactgccgttgagccctgtccacgccttgggagtgttgatatgttgagagttttctgtctggctgaggagggatcatttagtttttgcggacgtatgttgcactgaggatttagggagagagcaagatttctgttgaggaggttcagaagtataaggaatcgggagagtagataggagtgaagcatttggcagcgtaaagaagcttggcttagctttaatggattagggagagattgctatctagcattattacatgttattgttctctttgctattttatacacctagaacaacctttccctcggggttaacaaacatcttcaactctgttttctgtatggctcctgactcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404570 - DNA, 1235 bp, Homo sapiens
aagcagtgtatcaacgcagagtgcccattacggccggggctgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404571 - DNA, 1041 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagataccatgctgtgaagtccaggccacatggaggtgtcctgtgtagatgctccagctgaaatcccaagctaagctcccaactgacagccaacatcatttccagccatgtgtgggagccatcctggatgtccagccttaacaagccttcagaggacttcagccacagctattatcttactacatccttgtgagactctaataaagaaccaactagctgagcccaatcaacctatggaactgatagaaataaaatgaattgttgttttgtgccgctatgttttgg

SEQ ID NO: 404572 - DNA, 1137 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404573 - DNA, 981 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctgtgagtactttgatttcaccaggacagttgggggaacaaagataattttatttgtctctttttggactatgtttttggaataagatgagttagtagattgtgccaacgtgaaataaaatctctaacagtatccagtgaactctattctgttgatattttagaaggtagatacatgcttaccaaatttcaaatgatttgaagttgacagggccaactacttcattggatgatgggatctagaccttcaaaagatgttattaatgggcccatttagtaaaaggaaatttagttgagataacttatacattcctatatttgaattaaacactttccactgcttgagttcaggtaagtatatgt

SEQ ID NO: 404574 - DNA, 1163 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacaggtatttctcttattttaacttctgtcttcttcacctggttaataatagacaaaacgacgtaatgattgcccaattacatgtaagcaggtttgttggttctctctctccttaaagaaataaatcgtgtatcttctctttctactgccttctctccccaacttctttgcattaccatggtactcatcaatattggttggatgaggaacttttcttatcttgggaaagccttaatggcttttttttttcttatttactcactcattaaaatacttttcattactctaacacatgttataaagaaatagttggaaaagtacatcgaaagacttttaaaaatatttggtaactagtaaaaggactaccatcgaaaatcaactcaaaaaattgtccttttatgggttagctgtattataatacatatctatcatttgcccctgtgtcttagaggatataatttgaccagctctacatttaatctgtgtaattatgagactgttttacaacaatcttgatgcagagttggtaggttaagaaatttgtattacagaagttaaaaaaaaaaaaccaaaaactagatttttaggtttattttacaggcattcttatttaacacttaaagattttgatttccagttattaaaatggtagcttta

SEQ ID NO: 404575 - DNA, 2191 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaatggcagggaaaacaaactaacttccgtgcactccatataaaaacaa

SEQ ID NO: 404576 - DNA, 2123 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404577 - DNA, 2506 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaacaccacaaaacaaccagaaacaaacaaacaacattgtgtgggcgggcccgggccccgggaacgtttacaagccccaaaccgggtggagcgccggggccacagaagatgtaaggaaaccgggcaaaggttgtccccaaggaaaccccggggcccagacaaaggggtgggggttttccacccacattaaaaaaaagcggcgggggggcaccgcaggggtttggaaccaactccaaagagcgtcgggaggcactacggggatcatcaacgggggccaggagccattatattacgagtcggggttgtatcagagcacagcgagaaaccagcagcactcaacaaccacagcacgagaccagcattgacaccaaccacaaggcaagaacaccgcgccgacacacgatccacaccaaagcatat

SEQ ID NO: 404578 - DNA, 2541 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgggagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaagtatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404579 - DNA, 2012 bp, Homo sapiens
ggagcatcgtgtgatccattgtcggggctgtctgaaatgccagagggggtcagtcgtatacgcgacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404580 - DNA, 2355 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtaggttttgtcatcatacttaccttttagcttcttcctgtctctttagggaccaaagagttataaatctgaaatgttcacgtattaactgccctgtcacattgcctgaaaagctctttactgtgcttttatccagccatgttttgttttgttttctaaattttcccccaagtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404581 - DNA, 1217 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtctgtgtacactgggctcagtaagttgttatgttgctggaattgaactactccaccagaaactagagctccctgacaatcccagtactataaagaacgtttcaccataatgaccctccagagctgggaaacctaccacaagatctaaagttctggctgtccattaacctccaactatggtctttatttcttgtggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaataaaattaaaaatgaaaagagactcaaaaaaaaatagag

SEQ ID NO: 404582 - DNA, 1444 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacagagtcatttgatgtggtcacaaaatgtgtgagtttcacactaactgagcagttcatggagaaatttgttgatcccggaaaccacaatagcgggattgatctccttaggacctatctttggcgttgccagttccttttaccttttgtgagtttaggtttgatgtgctttggggctttgatcggactttgtgcttgcatttgccgaagcttatatcccaccattgccacgggcattctccatctccttgcaggtgacaaaggagagcatgcttccagctggagctgagtccaagcacacagccactcctgcacacgcatgcgtgcaaacagggaagcccaagtaggagaagaggaaagaggttgtagggatttgggaagaaccttgattattccctggaggaaaagacaaatctacttccctgaaatcaccctcgaatctacttccaccctcagaacttaaaatgaactgcatcctttttttcatcttcttttcttctccagtgaatatgatctccaaacccttattttttctttgaactgtaaaatttccactcatggacgatgcaaccaacagatgcaatctctgagaagatgaaaattgggacctcttattataaaattgacctagctggactcaggaaaccagggaagaagtcaatgcaggcatttaaaatgtaaagttttttctggttaaatctatttatttttcttgtaggttgagtatttcttcccagtttttctgctctggtgtataacaaacaggtcaaaatttcccatctttcctcctgatagtagttgaatcctaccttgcatacttaatgcatagtgaaatggcatctagcagaaatacacacccccaaaacacaccaccatttcattaggtgcccaaaaaattctgtatttagcttatttatttattggtatttttgctttttc

SEQ ID NO: 404583 - DNA, 2355 bp, Homo sapiens
taaggctaggtacgaggctggggttaattcggccgaggctcggcccgggccgcggcccggcccggagtgggggcgggcggaggcgcgggagttatggagggggcgggctctgcagggaagtgcgtcagaggaggcgcggggagagtagggtgctgtggtctgagctagagggtgaagctggcggagcaggaggatgggcgggagtgagcgggacctgcgtcgccgggcaggggtcgcgtcgcggttccatgttcccggcggtttgaagaggggcccccttcccgggcgtggtcgggctgggcgggttccgagcggcggatttgtcccagggccgagccctctagggcggggcctggtcgggtaccgggggaccctggcccggggccgagcacggctgccccgccccagccctggccttctccggccccgccgtgaggcccaggaggtggctgctgcaggcgtccggcttggacgaaccgccgttcccagtgctgggaccctttaaggtcatttgagagcaccaggatgaaggggggatttttaaaaaatcaaaatacaaatccaactttttgagttttcgttgtcattgctcttatctttcctgagtcacttcccattttccaaactcagcaaccccagtttgcgagtctgttttcatgaacctttgtaaggtgtttggtgcggtcacggtgtatacttgccgtgtagtatttgactcagcgcgatctgccttgagtcattttaccgcggccatttactactgccgttgagccctgtccacgccttgggagtgttgatatgttgagagttttctgtctggctgaggagggatcatttagtttttgcggacgtatgttgcactgaggatttagggagagagcaagatttctgttgaggaggttcagaagtataaggaatcgggagagtagataggagtgaagcatttggcagcgtaaagaagcttggcttagctttaatggattagggagagattgctatctagcattattacatgttattgttctctttgctattttatacacctagaacaacctttccctcggggttaacaaacatcttcaactctgttttctgtatggctcctgactcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttatgcaggtgatagactagagaacaagacctctgtctccgtagcatcctggagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacaggtatttctcttattttaacttctgtcttcttcacctggttaataatagacaaaacgacgtaatgattgcccaattacatgtaagcaggtttgttggttctctctctccttaaagaaataaatcgtgtatcttctctttctactgccttctctccccaacttctttgcattaccatggtactcatcaatattggttggatgaggaacttttcttatcttgggaaagccttaatggcttttttttttcttatttactcactcattaaaatacttttcattactctaacacatgttataaagaaatagttggaaaagtacatcgaaagacttttaaaaatatttggtaactagtaaaaggactaccatcgaaaatcaactcaaaaaattgtccttttatgggttagctgtattataatacatatctatcatttgcccctgtgtcttagaggatataatttgaccagctctacatttaatctgtgtaattatgagactgttttacaacaatcttgatgcagagttggtaggttaagaaatttgtattacagaagttaaaaaaaaaaaaccaaaaactagatttttaggtttattttacaggcattcttatttaacacttaaagattttgatttccagttattaaaatggtagcttta

SEQ ID NO: 404584 - DNA, 2076 bp, Homo sapiens
  misc_feature (964)..(964): n is a, c, g, or t
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatntctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagt

SEQ ID NO: 404585 - DNA, 518 bp, Homo sapiens
tggaggaataggccatatgtagagacagatgtgagactgaagtcttttttacatataaataatgctgggagagaatgagaacatttctgtaaggtggaggttggggaagaacagagttcacgattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagt

SEQ ID NO: 404586 - DNA, 1952 bp, Homo sapiens
  misc_feature (964)..(964): n is a, c, g, or t
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatntctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgttttttaactccggaatccgctctggctaaagctgccgctctccctgacgcagttttaccct

SEQ ID NO: 404587 - DNA, 2097 bp, Homo sapiens
  misc_feature (964)..(964): n is a, c, g, or t
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatntctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagt

SEQ ID NO: 404588 - DNA, 2319 bp, Homo sapiens
  misc_feature (964)..(964): n is a, c, g, or t
gtcttttgtccctcggcggacaccgtttgccagccaaagctatgtctgcgcgctcaccgacttcatagggtgccgaattcttttttccccaggcttgccatggctagtcgaggggctcggcagcgcctgaagggcagcggggccagcagtggggatacggccccggctgcggacaagctgcgggagctgctgggcagccgagaggcgggcggcgcggagcaccggaccgagttatctgggaacaaagcaggacaagtctgggcacctgaaggatctactgctttcaagtgtctgctttcagcaaggttatgtgctgctctcctgagcaacatctctgactgtgatgaaacattcaactactgggagccaacacactacctcatctatggggaagggtttcagacttgggaatattccccagcatatgccattcgctcctatgcttacctgttgcttcatgcctggccagctgcatttcatgcaagaattctacaaactaataagattcttgtgttttactttttgcgatgtcttctggcttttgtgagctgtatttgtgaactttacttttacaaggctgtgtgcaagaagtttgggttgcacgtgagtcgaatgatgctagccttcttggttctcagcactggcatgttttgctcatcatcagcattccttcctagtagcttctgtatgtacactacgttgatagccatgactggatggtatatggacaagacttccattgctgtgctgggagtagcagctggggctatcttaggctggccattcagtgcagctcttggtttacccattgcctttgatttgctggtcatgaaacacaggtggaagagtttctttcattggtcgctgatggccctcatactatttctggtgcctgtggtggtcattgacagctactattatgggaagttggtgattgcaccactcaacattgttttgtataatntctttactcctcatggacctgatctttatggtacagaaccctggtatttctatttaattaatggatttctgaatttcaatgtagcctttgctttggctctcctagtcctaccactgacttctcttatggaatacctgctgcagagatttcatgttcagaatttaggccacccgtattggcttaccttggctccaatgtatatttggtttataattttcttcatccagcctcacaaagaggagagatttcttttccctgtgtatccacttatatgtctctgtggcgctgtggctctctctgcacttcagcacagttttctgtacttccagaaatgttaccactttgtgtttcaacgatatcgcctggagcactatactgtgacatcgaattggctggcattaggaactgtcttcctgtttgggctcttgtcattttctcgctctgtggcactgttcagaggatatcacgggccccttgatttgtatccagaattttaccgaattgctacagacccaaccatccacactgtcccagaaggcagacctgtgaatgtctgtgtgggaaaagagtggtatcgatttcccagcagcttccttcttcctgacaattggcagcttcagttcattccatcagagttcagaggtcagttaccaaaaccttttgcagaaggacctctggccacccggattgttcctactgacatgaatgaccagaatctagaagagccatccagatatattgatatcagtaaatgccattatttagtggatttggacaccatgagagaaacaccccgggagccaaaatattcatccaataaagaagaatggatcagcttggcctatagaccattccttgatgcttctagttttgaaggctggaagaccaagatcacgatgccagtatagtcaagttctggtaaaggccatctttctggctgcagacagctgacttgtatcctcacatggctgcaagaagacaagctagctctctagcctcttcttataaggacattaatcccattgttgagtgctccactcttttgacctaattcccttccaaaggcccacctccaaataccatcacatagatcttcaaagctgctgcgggcattctatgtccccttcctgtcagatcagtatacagtgtacgtaaactacaccatcctcaaaccccggaaagcaaagcaaatcaggaagaaaagtggaggttagcaacacacctgtggccccaaaggacaaccatcttgttaactattgattccagtgacctgactccctgcaagtcatcgcctgtaacatttgtaataaaggtcttctgacatgaatactggaatctgggtgctctgggctagt

SEQ ID NO: 404589 - DNA, 829 bp, Homo sapiens
tttttttttactatcagaagacatctgttcttgattcagaagggtaaaaaaagcctaggacgtgctcattcacccatttctatgcttgcttctgaaaagatgtactatccaaacaatgatacattcttaaactctgacatataaaaatgctcaagtttaattcattttttgctttgtagttacagactttgcaaattaataaaaatgtgtcataaattgggttccttgggaagcaaattctgagatggagatggaaatttaaagaattgggaagtgattttgggaaaacctttgtggaagagcaggagtgggcagagagagaagctgacttatcaaagagtttcaacaagacctcagccaaaaccatgggcaactctggagctaggaaggcccttcagaactgaccaagctggggccaaggagcagactttgtaactctgcaaatatcagtcactggatggtggcagccctaagaagacaggagtttgggcaaggcagctctcctagcagccaaaggcagatctgggccacgtaccacaatccaccaatataccatctacaaaaaggagggcctcctaaatttaaacatcctgttcctttcctttacattttgttctctgaagatttaactctgctccttttctacttactaaaacatactacaaaggggcagcaagagggagtttttcgtgatggaattgttctaaatcccaatgtgggtgctggttacaaaaatttacctatgttaaaacacatataactggaaaagagtacagcagttcctcaaaaaattcaatataatttcatgatgacaacccacaaggaaaaa

SEQ ID NO: 404590 - DNA, 362 bp, Homo sapiens
ctcattgcccgggccggcagggccggccggctgctctgagtgcggggtctgccaagcccacgcccacccggaattccagctggcccgcaagtgccgcgcgcagccccagttcccgctcgcgcctctccctccacacctccctgcaagctgagggagctggctctggccttggccagcccagaaaggggctcccacagtgcagtggtgggctgaagggctcctcaagtgccaccaaagtgggagcccgggcagaggaggtgccgagagcgagcgagggctgtgaggactgccagcactgaacagttaggaaaatgagtggattttctgcatcaaattttcagtagttcccaggaacagttagc

SEQ ID NO: 404591 - DNA, 205 bp, Homo sapiens
aaaagtaattttaaagtaactatcttagagaactgtggattaaaccattccagccatctgatgagggttaaaatgtatattcgtaatctgacattccaaaacacgattctttccggatcaagcataaaaggcatttgctcttggaagaccaagaaagaattcatgtggttcccattagtctaaaaataaataataaataaataaa

SEQ ID NO: 404592 - DNA, 391 bp, Homo sapiens
tagtagagacggggtttcaccgtgttagccaggatggtctcaatctcctgacctcgtgatctgcccgcctcggcctcctcattgcctgtgataaacaacgcactggaagtctgagacagcatagtaagaaataaaaacatgaagaaatagaaagaaatgagaaagaaagaaaccggtcattattcagacaatatggttatctacatggaaaatttaagataatctgtgggcaaacctgtaaaataattcaacaaggtggttaataagacaattataagataaatatataaaaatcaaacaccagttttatatagcaataacaattaaaaatgtaattttaaaaatatatcatttgtaatggaaacagaaactttaagctacccatgaataa

SEQ ID NO: 404593 - DNA, 540 bp, Homo sapiens
cgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggctcacgcctgtaatcccagcactttgggaggccgaggtgggcggatcacgaggtcaggagatcgagaccatcctggctaacacggtg

SEQ ID NO: 404594 - DNA, 430 bp, Homo sapiens
tggtctcaaactcctgacctcaggtgatctgcccacctcggcctcgcaaagtgctggcattagaggcgtgagccactgcacctggcccattattctttttctaagaggggagtcttgcttgctatgttgccagggctggcctcaaactcctgggcttaagggatcctcctgtcccagcctcctgagtagcttgggactacaggcgtgtaccacattcttccatttttgcaacttttctgtaggttttaactctttcaaaatagaagttgggataaaaaatgtccttcacgtaagctacaaaattgcttgaaacaagttatttttgaaaatatttagtccttttcaggtttacatcatgtttaagcaggtatgtattcttgtaattttaatatgtatattaaaattgtgataatttttgtctagatgtgga

SEQ ID NO: 404595 - DNA, 342 bp, Homo sapiens
tgataagaattcaagtttagctatataccctgtttgtcaaagctgttaagcaacagacattttcatgcattactgtggaaatacaaactggtgcagtccttatggaggcattgacagtatcttacattttataagcgtttgtcctttgacctagcaatcccatttcagggaatcaagcctttaattacacctgcacaaatatggaatgatatgcattcagggtgattcactgggacattaattgtaatagcaggacattggaaataatccaaatatccatcagtagtgccctggttagttaaattatttatatccacacaatggaaggcaaacatcaaaaaa

SEQ ID NO: 404596 - DNA, 289 bp, Homo sapiens
atcaatcataccatcatatcatttcctggtgagatgcataggaaatacagagcatcacctattgccaaaaattgaacctaatcaagcctcaagatctaactaccagtttataggctatatagagattagcaggaatatgttaagacaccaaaggtatgaaatcaaccatatccaaaatgtaggaaattatatgggacaaatgatctgtcgtcttcaaaaaaatggcaaagtgggaaatgtgggaggggaaaacacttcagaataaaagagatttaagagatgtatcaac

SEQ ID NO: 404597 - DNA, 549 bp, Homo sapiens
tccgtctttatttatgagcaataatttcatctttttaaaggaaagaaattaaaacagctataggatcctttgaggcttttatttgtcatctggtctaggagaaacaaaaaaaccaccaccagtgggcctttctatgaagatcagcaagaaagccctgctttctatgcctcgtggaagggaaggttccttctgggttaccatttgagttgtttctcaatgcgtcattgctcctgctttcttgttttcaagagtataagacctagtattggatgttgacttgagtgccatctagcttttttgagtcaccttacagtatttaagcacttttcaatgcagtgggtcagcaggggcgttcaaatacagtggtcaacctctaacagagtcctctgaatttccatcccttcttctctcctgcttgctttcctttctgtggtggcgatgacgccgttaggttgatgtagagagcaatgttgacatccttgattgtcctctgactgtaagtcacccacgttccctttgttagcgtaaagtgggccctgctctcctgtg

SEQ ID NO: 404598 - DNA, 622 bp, Homo sapiens
ccccatctctactaaaaatacaaaaattagctgagtgtggtggcgcgtgcctgtaatcccagctactcaggaggctgaggcaggataatagcttaaacctgagagcggaagttgcagtgagccgagatcatgccactgcaatccagcctggtgacagagtgagactctgtatcaaaagtaataataataataataaaataaaattatatgatgaaaaacataattagaaagccgaatagtactattcagtttccttataaggaaataacttttactcagatctttttcttaaagtaatttttaaacttgagtcagtcaactgagactatgcaagctgcagagggctcatgtagggagtgtataataaataacttctggagttctggtataatattatctcttgatcttgatgctaacagtgttttcatgtgaaaaattcatcaaattatacacttatgattcatgtacttttctgtgggtatgttatacttgaataaggtttgcacaaaataaaatacaagtaaatattaaaacacataatttagaagaaaacaaaagaatattatcatgattttttggtaggtgaagactttttatcagggcacaaaatctgagagccata

SEQ ID NO: 404599 - DNA, 583 bp, Homo sapiens
ttggttttgtgtccatgagccatttacaaactttgcacctgattgggctcagttgcagtttcttgtatttccctaccagccaagctgttgaagctgctgagcccggaatgatgttatcactgaggcagatgacaaaccctctagttgctagaaaccaaactgctccccgagctggtgtttccgttttttgtactgactgcttatttgggcttgatatataatggtgaaaacaggaactgtttattttaggtgataagaaaccaacattatgacaagaagatgtcatcttagttactctgttaccagtaccataggccagatactatctagatgcttataaacatcttatctaatccttgtaataataagccccaagctaggttttatatccccattttatggatgggggaactgaggccaataacttcatataacttatccaaggccacaaaactagtaataaacagagtgaaattcaacccaaaaacaaactacaaatccaaatttctttacctctatgctgtctgtacttgctgttactagcaaagttctcttggtgggagttaccccatcccctctccaa

SEQ ID NO: 404600 - DNA, 521 bp, Homo sapiens
tcagtttttgtagccaattaattttgagagttactggtaaggttgaaataaagtagcactgaactgactcaattttttaaataacaaaaaaattccttggtgttctagtatttgagaattcacttttagaaccctattggtacattggtggataacactacaatgggactgtggtgtccttgttgtacagaacaggcaaagaattcaaaatgctagagagccagggagtgatgttttaaacaaaaacaacaaaacttgaaaataggcctgtaggccaggtacagtggctcatgcctgtaatcccagcactttagtaggccaaggcaggtgaatcacctgaggtcaggagttcgagaccaccctggccaacatggtgaaaccccatctctactaaaaaattacaaaaattaactaggcacagtggcaggtgcctgtaatcccagctatttgggaggctgaggcaggagaatcacttgaacccaggaggcggaggttgcagtgagccgagactgtgccattgc

SEQ ID NO: 404601 - DNA, 387 bp, Homo sapiens
tggttttctggaaagacagtattggcaagtgacacaggatggtatcccagttgtaagagggttgcatgattcttttatctttgatttgaaaagcctggtcttggaccgggctcggtggctcaagcctataatcccagcactttaggagccccaggtgggtggatcacgaggtcaagagattgagaccatcctggccaacatggtgaaaccccgtctctactaaaaatacaaaaaaattagccgggtatggtggcgggcgcctgtagtcccactgacttgggaggctggggcaggagaatcacttgaacccggggggcagaggttgcagtgagccgagattgcaccactgcaccccagcctggtgagagagtgagactccatctcaaa

SEQ ID NO: 404602 - DNA, 550 bp, Homo sapiens
gccagaatgattggagaggagaggtaggagagaatactcactccctagtttgtgcacatttaagatgaagattttgttttactgggtttgctttgttagattctctcataggcagtcaatatcttttgtgcacctacttcattcatttgtgcatttgacctacgaaatattcagcattgcactaagtgctaggtgtatatgatagacaaagtccctgccagtgggggagcacaattttaaagcaatagtaattattcacgcttgtgctaagacctgtaatgaagttcttaatgatcttatgatcccagaagatcataatggaggagcttgcctgatctttgccgatgacattcaacctggaacaaggataaggaggattgccaggtaaagagagaggaagagccccagggggagggcgcagcacaagcaaaggctgaaggtggagaggaaattggggcagtcagaaaccagagtggtggccattgtggttgagtgcaggaggtttgggggccagtggcaggagccggagctggagaggcaggtaggaccc

SEQ ID NO: 404603 - DNA, 395 bp, Homo sapiens
tagagacagggtctctatctggtgcccaggctggactgcagtggcaccagcacagctcactgcagtcttgagcagccttgagcagccttgagcagccttgaactcctcggctcaagtgatcctcctgcctcagctttccaaagcaggctgagattacaagcatgagccactgcacctggtccctaaaatgggagaattaacagcatgtttgtatgctgatgagaatgacccaacaaagacaaaaaattagtgacacaggaaagagaggggaagatttgtggaacaacatccttgaaaaagcatgggggatctgtgccaaagagagacacagacatacaaaggtgctatccttgggtcgcaatgagatcaccagtccattgatcctatcacctttt

SEQ ID NO: 404604 - DNA, 588 bp, Homo sapiens
gcatgacatcgtgaatgtcactttaaaatggtaaatattttttaaactacatgtcacctttacctagtttttcatacttcaggaaaaaaaagaaaagactaataaacttatcagaaatatctttaaaattgtatcacagattctttttttgaagaagaccatatgaaaaggtaagagaaagcaagattcattttaaaactgaaagagattctgaccagtaaacattctggtcacaagttgtgtgttccatgggacatgacggtgttgctatgtgtgtgtagaccccgtgacgtcagtatgtgccaggtgtctcatccccgagtgaccagtcctgcacacgtggtggtggtacatgctgtgtatagacagacgcgccatgccagggcccaccatttgtacgtgtgtgcacaactctgcccatctgaaggaaggcaggagagatgagcgctgcttgacttcagaaaagcatctgacattattttgagcaatgtagaacaatgttccttggccccacatggaaactagttctgttatctcctctgcctcttcttccccccaacatttgcaagacgttccaattagtgtgct

SEQ ID NO: 404605 - DNA, 638 bp, Homo sapiens
ctctacacaggtaaattttcatttaaaggctacacaaacagaaaaaaataattctaagacagtatttatattatgaaagaagaaatggtaaaagccacagccaaggctgcctttcccaagatacctaaacattccagtgggggaagagtccctgtcaagagttaaaaacaatcccctcagtccacactcccagtcacatggagctggaagagctggaagaaccgccgccaccactcattcctctttcttcatcatttatttttatcttcatccagcatttcctttctttgtgataccaccagtagataccagctcaacaacatgctatcccccgctccatgagttctcccgagggaatgaactatatacgcttatataaaacagatgtggtctcttatttgagaggaaaaactaagggtaccataactcttccctttatctttgtccctagaacagtaatccattttctctgagcaagtgaacaactgaagtcttcagaactcaactgcgaaaagctgcagacaaggcagctaatcctctgttgtcagctttcactgatggcaacccctcatatgtctcttccatttgcctcccgagtttttacagtaggatccctatggccctactgccacaagcag

SEQ ID NO: 404606 - DNA, 424 bp, Homo sapiens
caacctaaatttaatcatgaagaatcaccagacaggccgggcacggtggctcactccttgggaggctaaggcggccaaatcacttgaggtcaggagtttgagatcagcctggccaacatggtgaaaccccacctctactaaaaacacaaaaattagccaggcatggtggcgggtgcctgtaattccagctactggggaggctgaggcaggtgaatcgcttgaacctgggaggcagaggttgcaaagtgagccaggatagctcgccactgaagtccagcctgggggacagagtgagactccatctcaaaacaaacaaacaaacaaaaaggatcaccagacaaatcgaaactgagagacattctacaaaataaccagccagtactcttgaaaaaagttccaaaatcattagaggcaaagactaaaa

SEQ ID NO: 404607 - DNA, 528 bp, Homo sapiens
tttggggccaaaccaatgtataccttgcatgtattgatctatgtctttgttgatatcttctgtctccctaaaatgtataaaacctaactgcagccagacatgcagctcacacctgtaattccaaaactttgggaggccaaggcaaacggatcacttgagcccaggagtttgaggccaggctgggcaacatggcgagacctcgtctctacaaaaaatacaaacattgggtcatttttagtcacagtaaggatagtatgtttatgtaatacttctctaccataaaagcatatcaaggctttagaggtacatctctcaacaaacagtctttacccatttcttccagaaaatgaccctgctcttttgttcatcttcctcctcttattgcatcaggtttaaatctctgaaatggaggggaatgacttttgcaactaaaagaatttgctaggcctaaggctaatgccttattaaagcattttagtgaaaactcaaggcataggacagaatagacttactattatatctggccca

SEQ ID NO: 404608 - DNA, 556 bp, Homo sapiens
agtgaagcacataaataagtggctttattttttctctggtcataattgctgaaaagtcaaattcacagtttgctgacattggtacattggactaagaaatagttgtcttcgtggttgggggtggggagagtgtagaaccctaggagaatattctgcagagttggcacatcctggataaaaggtataaacgggcgcccatgatatatatatatatatatattttttttttttttttttaataatgagagctatttcagctggtgtggggttctgcttctagcaaaagaatgcctctggtccctcctgtacctgccccagcagcggggatactgtgtgctgaccgggctggcacgtgcagttgtgctcctttgcaggagaaggagctcgcccagaggccggagcagtgagccgggggccacgctggagggagcgggcagcgccgctgctcctcgcccatccccatgccctgcagcagggcgcgaaggcggaggcccaaggcagcacccctgcccctccagccctgcccgcccgcccggggctccgggacgcggccgcc

SEQ ID NO: 404609 - DNA, 515 bp, Homo sapiens
agtttccagctagtgtgttgagctcaaaatgtttctgtttgttagttgtcctagcatattggtgcttcttcacctcatcctttgagaattgctggggcttcctatttagaatggagctggctgggcacagcccattacatgcctgtaatcccagcactttgagaggccgaggcagtggatcacttgagatcaggagtttgagaccagcctggccaacatgatgaaaccctgactctactaaaaatcccaaaaaaaaaaaaaaaaaaagaatggagctgcctctggaacttcctctctaaccccagcattttcccttcctattcccaagtttagggactttaccgtcagccttccctgtcctcactttccagtcagctgaaagtttcaagggaacaaaatatttctttcaaaagataggaacctgttttaaaggtattaattgtgcttcaaaatcatgccaccttattaaaatatttgtcacttaaaaataaacttacacttcctccttgaattta

SEQ ID NO: 404610 - DNA, 442 bp, Homo sapiens
acatttgttgttgctccctcagtgttagatactgttctgaatgctttgcgtgtgtttgttggttccattttaataaccacaggaggaaattcagtccttagggaggggccacaacagttgcagccctgatccaaacccatgccatttccctccatgtcttcaacgcgatgctctcctgactcatcataccttgtttcgttccaaaaatgttttgaggtgaatgactttttactattaggctggcgcaaacataattgcagttgttgacgttagttttaagggcaagacgcgccattacatttgcaccaacctggcaatgactagccaagtgcaatggcgtgtgcctgtagtcccacttactcaggaggctgagatgaggtgatggcttgagcccaggagtttaagatgaccagactgggtaacatagcgagacaccatcaaa

SEQ ID NO: 404611 - DNA, 310 bp, Homo sapiens
aaatttacccatttccaggtgtaattccatgactcttagtaacattaccaagtgatgcaccatcaccataacccagtttaagaacattttcatccctccagtgatatccctcaggtacatttattcttaatccttatttcaattcccaaccccagctctaggcaatcactacctactccctatctctatgaatctgccttttctgggtatttcgtagaaatctttgttccataggcttgatttaaagacaattagattagatcttttactaagccttttactctataaatatatgtcttttcacaagaaa

SEQ ID NO: 404612 - DNA, 248 bp, Homo sapiens
gctccttgctggctctgcccgttctctcaaagccctgggggttctgtaaaagctctcaggattcctgtaatcctgcctcctttctcttaggctggcagcctggcagactagttcttctcggtgctgaattatgtaccccgcttccccaactcgcccgcactcctgtgtcttacgtgggtcctggggtccggcaaagcctgttctccccactcgaaatgaagtcatttcaaagtcttgtctttcattct

SEQ ID NO: 404613 - DNA, 391 bp, Homo sapiens
agggcaggggtcctcgcctgactcactgaatgccttatctaaagtgccaggcacagtgtacctattcatctggtggatggataaagacagggactgtcttggttcttcctgtgtagccttagtaacttgtacctttcctgacatggcaggggctccaaaacatctgttgcaaacaatgtatatctaaaagacctctataaaaataattagaatgtaaaactgttaacagaatggaggttgagaaaggattgtgtattttttaaatgtggtttaaatcttttcagcttgcagatgctagattttcctaagctctgcaactaactgaagaacaagtattgatgaagccttcacagttcttttttttttttttttgagatgtattttcactttt

SEQ ID NO: 404614 - DNA, 565 bp, Homo sapiens
gatgccaggtgcctgtaatcccacctacttggggggctgaggcaggagaatcgcttgaacttgagaggcagaggttgcagtgagccgagatcatgccattgcactctagcctgggcaacagagtgagactctgtctcaaaaaaaaaacaaaaacaaaaaaacccactaaattttaaaaaaggaaagaaagaactgagagaagcacaaggactatcagaagaccacggaacttgagggtccaggatgacttcctggaggaggtgacatgtgggctaagttttaaaggactattaggaattgtaaagagctgaaggtgtggagaccagactgcagaggggttgtagtgacaagctaaggagctgcggctttacaccacttgagtgggctgcccattttagtatgaataagaatttcccgtggttttcttatttaaaatccagattttcattccgtaggtcttggtggacccagacatcagcaaaagcttggctgtaagaaacagcctgggtattttgttgttactttttcttttaaaatatttaatggataaacaaaaagtgtatat

SEQ ID NO: 404615 - DNA, 519 bp, Homo sapiens
tatcctgtctgagaaactggggatcagaaaaaaggctgtcagtaccctattggagattctttctgatcttctttattccgaccccagtgtgggcctagttggatctctccttcggttgcatttatcttctacttcccaaattaaggaatttgatatttcccattgtgttcagtgtacagcatagatgggaggagcatgggaaactcctttttaaaagataaccattatcccccttggtggggcattatagcacgcctccagcatactatgtaaaatggtctcatcataaaacactagttgactcaagcaagtcagcactatcactttttccttcctaagacttactgtgattcccagatggaaggctgggccaactcaaaggctacaatctctcatttcagtcccagctactcgggaggctgaggcaggagaattgcttggaccggggaggccgaggttgcagtgagccgagatcatgccattgcactccagcctgggtgacagagcaagactgtctca

SEQ ID NO: 404616 - DNA, 400 bp, Homo sapiens
gggaagcctcaggaaactcaatcatggcgtaaggtgaaggagaagcaagtaccttcttcacaaggcagcaggaaaagagcagagagtaggggaaacagctgcttacaaaaccatcagatctagtgagaactcactcactatcacaagaatagcatgggggaaaccacccccatggtccaatcacctcccacccggtccctcccctgacatgtggggattacaatttgagatgagatttgggtagggacacagccaaaccctattatcccagcactttggaaggctgaggcgggaggattgcttgagttgaagaatttgagaccagcctgggcaatatggcaagatatcatctttatattaataataataataataataataataaaagcagaaatcaatt

SEQ ID NO: 404617 - DNA, 610 bp, Homo sapiens
cagtggctcacgcctgtaatcccagcacttcgggaggccaaggcgggcggatcacaaggtctggagatcgacaccatgttggctaacacggtgaaaccccgtctctactaaaaatacaaaaaattagccgggcctggtgtcgggcgcctgtagtcccagctattcaggaggctgaggcaggagaatggcgtgaaccccgggaggcggaggttgcggtgagctgagattgagccactgcactccagcctgggtgacagagcgagactccgtctcaaaaaaaaaaaaaaaaaaacgaaatgcatttaggaaaacatgatcttagcatgataatgattgtggcctttatagtactacctagctgcataatttgtaagtcacaatttgctattttcagagaaggaagagagtactgttcttgacttatatactataaaatttacttttagtcagtttgtgatgttgcctatgtatatcaacaaatgtactttgatgttcgaactaatatattctcaagtgaatgtttttgtcatggaagagaaaatgaatgttgttttacatgctttacatagctgttcttgagtgtgaactttctgcagcctatatgcagtaa

SEQ ID NO: 404618 - DNA, 718 bp, Homo sapiens
ctcagcctcctgagtagctgggattacaggcgcccgccaccacacccagctaatttttgtatttttaggagaaacagggtttcaccatattggccaggctggtctcgaactcctggcctcaagtgattcacccaccttggcctcccaaagtgctgggattacagtgagccactgcgtctggccctcaggcttactttagaaatgagaaggtgaaggtgggtccagagcggagcgtgtgagttccaggcttggcagggtgccctggcatccagcttacagggagtctgagtttgtgtagaatctgcctcattgttcctgtgtccgtggagaattctttccatcccaaaccatcctgtctaagctctgaggaggcacaggtggctctaaggcggcactggcttttgcctgcaggggcaccatcctcagctacaggtctaacaggaacttggtgaaataagcaggccccactggccggacctccctcccttcgtaggacagatgctctgctcagggctccatgagctgtttgagagaaggtgtggggtttgttcttagaaacatcatgctttctgttggggacttagggtccacactggccagggaagggcatcgggcatctgtcgttgtattccaacacttgggaggtgagggagagaaattttaacccgagggggagttttgaatggccaaatggccccttcctccacctgggcacaaa

SEQ ID NO: 404619 - DNA, 673 bp, Homo sapiens
tggcgtagccttgtagttgaggacgagaggggtctgatcgcgatcggccgaggctggtctcgaactcctggcctcaagtgattcacccaccttggcctcccaaagtgctgggattacagtgagccactgcgtctggccctcaggcttactttagaaatgagaaggtgaaggtgggtccagagcggagcgtgtgagttccaggcttggcagggtgccctggcatccagcttacagggagtctgagtttgtgtagaatctgcctcattgttcctgtgtccgtggagaattctttccatcccaaaccatcctgtctaagctctgaggaggcacaggtggctctaaggcggcactggcttttgcctgcaggggcaccatcctcagctacaggtctaacaggaacttggtgaaataagcaggccccactggccggacctccctcccttcgtaggacagatgctctgctcagggctccatgagctgtttgagagaaggtgtggggtttgttcttagaaacatcatgctttctgttggggacttagggtccacactggccagggaagggcatcgggcatctgtcgttgtattccaacacttgggaggtgagggagagaaattttaacccgagggggagttttgaatggccaaatggccccttcctccacctgggcacaaa

SEQ ID NO: 404620 - DNA, 1398 bp, Homo sapiens
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgta

SEQ ID NO: 404621 - DNA, 1540 bp, Homo sapiens
acgagctgacgcagccatggcggaggcggctttggaagccgtgcggagcgagttacgagaattcccggccgctgcaagggtctatgtcctgttacattctaagtgagaacgtggacaatcaaccacaggtgtactgaatgagtacattgtagagtagaagaagtaggttagaaggtaagtgcaggcaaagccctctttgggagtatgcctgatgtgtttaggaaacagtgaagaagccagtctgcaggagcagcgtcttctgcgcatgtagctctgcgtgcctcttgctgtgccctacctggacaaacccccaactccgctccacttctaccgggaactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgta

SEQ ID NO: 404622 - DNA, 7913 bp, Homo sapiens
  misc_feature (3249)..(3249): n is a, c, g, or t
  misc_feature (3263)..(3263): n is a, c, g, or t
  misc_feature (7911)..(7911): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggnaggccgaaaggaancagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggatggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttgggggtgagtggcccaagagctgagacctgtgcccttgcagttggtggaataaggggagaacgaggactgtgtgcagattgcagatgtcacacccacctctcctgagccaggtcccgtgctttctggagaccggcaccctaccagggtccctcagccctttgggaaggaggcaggggccttaggtcctatgcacgaagcccaggccacaaggcctgggcctcctggtcctcagctgccctaaagcaaaaccctgggtcggggtgggggtgtgggtgcctaagggctctgcaccatgaggctgaggcgtggactcctcacagagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctgggtaagtgctccgggcccttcataagggtgccaaggggcagccagctggggctgcaccagggggcggggggttcacacctcttccccctccagggtcaccaccaaggtggggataaaggtgcaggagtccccatttcccccaccttgcctgtgtagacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404623 - DNA, 4715 bp, Homo sapiens
  misc_feature (4713)..(4713): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404624 - DNA, 7549 bp, Homo sapiens
  misc_feature (3357)..(3357): n is a, c, g, or t
  misc_feature (3371)..(3371): n is a, c, g, or t
  misc_feature (7547)..(7547): n is a, c, g, or t
acgagctgacgcagccatggcggaggcggctttggaagccgtgcggagcgagttacgagaattcccggccgctgcaaggggcccggtgccgtcttgaccgtggtcgcggcgaagccctgtgtttcctacagtcttgagcagcttgctgttacccttgttgaaagctcatcgaaggcacacagctggtgagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggnaggccgaaaggaancagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggatggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404625 - DNA, 4475 bp, Homo sapiens
  misc_feature (4473)..(4473): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggtgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404626 - DNA, 5020 bp, Homo sapiens
  misc_feature (5018)..(5018): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcaggtgggagctgccctggggtcaggtgtgagcagtgattactggcatctgggcatgggctgagtgtccattcctctagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgtctgtcctgttcttgggctctagggagggagaagggcagaagcctggctctgaagaacaggcacaaaagatctggggaggtggcaccttgctctgaaaagtctctaagtctgaggcctttcactgctgagccaagcagggcctgtggtgttgacctttggaagggacagagcctgaagtcctggggggtctggggggctgctccctggcatctgatgtgttcccaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404627 - DNA, 1882 bp, Homo sapiens
  misc_feature (1880)..(1880): n is a, c, g, or t
ctggccatggggaagggtaggattgggacaagagtcgggggccctcttccctcacggccgctctttcaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404628 - DNA, 932 bp, Homo sapiens
  misc_feature (930)..(930): n is a, c, g, or t
ccttcgactcttcgtgccacttatttgccgcctgcctgcatgccattgagggttcccagcaccatgagggcctggatcttctttatcctttgcctggccgggagggccttggcagcccctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404629 - DNA, 580 bp, Homo sapiens
agccccacctgtgcctgctggatgttggctacctcatcaataccagctgcctgcccctcctgcagcccactcgggacgtggacctcatcctgtcattggactacaacctccacggagccttccaggttgggaagggtgggcagcccaccagggaggcggtgggtggcccctgtcccctgaagagaggggctttggagtccagtgtctggttcagcttcctttaggagctgtgattgggacactggaatcttaatttgccaccagaggagctcattcttttccggaagttgggaggctggcgaggttctcctggtatcttgtagctgggtcccctttactgacctgcgaggtgtggtcctgggcctctgggcccacctgctgagtctgctttggctcccagtgtcagaactggaatgctgggagtaacccggctccgtctagccccagaggagctgccaccgaggcctgtcaggtgtggagagtttttttccaacgactggcttcataggccccactggagaccgttttggcatttgagccccaggtcctgtgcatcttacgtcagccccagtgttgagga

SEQ ID NO: 404630 - DNA, 4017 bp, Homo sapiens
  misc_feature (4015)..(4015): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404631 - DNA, 7365 bp, Homo sapiens
  misc_feature (3173)..(3173): n is a, c, g, or t
  misc_feature (3187)..(3187): n is a, c, g, or t
  misc_feature (7363)..(7363): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggnaggccgaaaggaancagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggatggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404632 - DNA, 7407 bp, Homo sapiens
  misc_feature (3215)..(3215): n is a, c, g, or t
  misc_feature (3229)..(3229): n is a, c, g, or t
  misc_feature (7405)..(7405): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcaggtgaagagttgcccaggccacctggggaagagccctgccaagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggnaggccgaaaggaancagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggatggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404633 - DNA, 4944 bp, Homo sapiens
  misc_feature (4942)..(4942): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgtctgtcctgttcttgggctctagggagggagaagggcagaagcctggctctgaagaacaggcacaaaagatctggggaggtggcaccttgctctgaaaagtctctaagtctgaggcctttcactgctgagccaagcagggcctgtggtgttgacctttggaagggacagagcctgaagtcctggggggtctggggggctgctccctggcatctgatgtgttcccaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404634 - DNA, 6977 bp, Homo sapiens
  misc_feature (3173)..(3173): n is a, c, g, or t
  misc_feature (3187)..(3187): n is a, c, g, or t
  misc_feature (6975)..(6975): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcagtgaatttctggtatgacatggaatacgacctcaagtatagttacttccagctgctcgactccctcaccaaggcttcaggccttgactgatggagcactggtgaacacgaccaagcacgcctcgggggacggagccagcccctccctggccaggtcaattctcgagagagcctggagtgtgcatgctggctgctggccccgggtccagcatggcttgagatcagctttggaggatcttggaatgtggtcataaggactcaaggtgccaggcaggtctgggtgagggttctcaggaagttgccacacaggtgagcagagtggggatcaggtgcagcggcacctctccccagcgctgtgatgttgggcgagtcactgcgtctcgggcattggtgtcctgtcagtaaagagataataatggctgtacctcgcggggctgttgtgggcttggagatgatgtctatgaggaccagcatggagctggcacacaggacatgttgaataaaaggtagctgtgagtcgtatgtccttttttttttttttttaagatggggtctcgctctgtcacccaggctggagtgcagtggtgtgatgtcagctcactgcaagctccgcctcccaggttcacactattctgcctcagcctcccaagtagctgggactacaggtgcgtgccaccatgcccggctaatttttttgtatttttagtagagacggggtttcaccgtgttagccagtatggtcttgatctcctgacctcgtgatccacctgcctcggcctcccaaaagtgctgggattacaggtgtgagctgctgcgcctggcttatgagtcgtatgttctgatcctccctcttgaagttgccttctgtggtctaaggagggcctgaaggttcaggtaaaaacttcagggtgaccttcactgggggtgagggctggatcccagcctgggcccaaagagccgtcagctgcccaagtcccgctgtccatgagagtcaccgcagcccctccctgggacaagcaagcagacctgagtcttgtagctctctggtccggacctctttgcccaggaccttgagagctattcctagctctcctatggttactgtcctcccccagttcaggggcagcaggtgggacctggtgccctggggataacccctgtttctcccataacaggcacaggcaggaagggacggaagcccccgcctctcctggggctgtccctctgaggaaagagttggtctccacacgctgacccccccacaaaccatgccctggaggcagaagaaccccctgcccctgagtgccaacccacaggcctcatccctggccactcagcacctagctttgaagggctgttttatgtgacagccactcccctgcctgtcgtgagggggcccgggtgttcatctcagattgatggatccctgccatcaagactgggcattcctgtccaacaggtgccagagttgcgaaaggcctgtgacagggaactccactcttcccttggctgctgttctgggactcacccctgctttccttctgctcagcccctggcagcaagctctccaggctgggattgcagggctgggtggggcaggcccagctggtaaaggctggcgagtgccacagaggtatcaggagctctagtataggcttagggtgcctcatttcctggacaggtggctggttcaggagtgggtgtggagcttaggtggagcagaggcggcgggtaggagggacttgggaccaattgggacatcacatccctggctctgggttagaaagctgacagtccttgatcctgtggccactgccccatcattcctgctcctgaggactcagtctcatggctgtggtaaggcctggcagggccctgggtccctactgggacccctggtctctacctggggcctagttaatatgtttcttatgggagctgtggtcttctccaggggtagggaggggagtttattgaccacaagaccagggtagcgggcagaagccaggggaggaggaggcttggggatgagggatccgtcctgagtgttttctgtcctgggaacgggctcctggcagagctccctggcaccacagatttgggccctggagactcagaggctcccagctgccgccctgaggccctggaagcaagtggctcctccatgctcctctgactcagttgcctggagtgtgagggccctgggctgaccctggtggatgaggccctccagcactgccctggacctggttgctccctggacttgacctgttagggtccttgtggaggcaggtggnaggccgaaaggaancagttggcacaggcttccctggtcccggtgcgcctgccaggctgcattcccagaaccaggggcatgggtttggagggagctaccgggggaccatcttcagcctgacctggcaggacctggaggacatgacagcctgtgaggggtctgagctaggagccgcctcccctgcccaggagagagcccatttccaggatgctcttctgaccagggtggatggagggtacgagagcagctcagcctggggcccaaggccctgatgtgctacttcccctccctcgatagcttatgtcccctgccacccaagaccagccggaaagctgcttagctggggtgtgggctggggatgtggggtggagagcctaaaggatactagcccgagaaggtggaagcaggtctgtgtgaggcataaatctggagccagcctgcccgggctccaaccccaattgtggacctcaggcaagtgactgcttctctgtgcctcagtttccttgtggagtgggccatcgtaaatagtatctgtgcataaggtggttgtgcgataaatgagttaatgtatgcaaagcccttggcccagagccggcgcagagcattgtgtaagtgctggcaggcgtcatgatggagatatcatgtctcctcttgttgattcaggattctgatgagatggaggatgggcctggggttcaggattaggccttgaggcactgctccagcctcctttgtggcccctgtcacccttggcttcatcggcccgtagcaggtctcccctctcccacctctgcaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcagggctggagtgcaatggcgtgatcttggctcactgcaacctccgcctctggggttcaagcgattctcctgcctcagcctcccgagtagctgggattacagactgagggagctggccgtgcgactgggcttcgggccctgtgcagaggagcaggccttcctgagcaggaggaagcaggtggtggccgcggccttgaggcaggccctgcagctggatggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404635 - DNA, 1776 bp, Homo sapiens
  misc_feature (1774)..(1774): n is a, c, g, or t
acgagctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcactgtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaaaaaaaaaaaaaaaaaaaaaaaaaaaaaaaaaaaaaaaaaaaaaaaaaaaaaaaaaaaagaggggggcgcgcgcgccccaaaaaatctctctcccgcgagggggcgcgcccacataaagcgcgcgcagcaccccgatatttttgtgtgatgaaaaagaggggggtcgccctatatagataggggggttggtcttatattatagataatcaacagcagaagaccgggaggggcacagttgatataaacaacaaagatgtgttagtgttggcgtggagaaaacaagcgagtcagcagactaaggggggaatcaatcttgtagggaaagagaggagacccatctcattttagtgggggaggggagggaacaataattgatggggaggagaagacaatctcctatcagagtagaatatattaaaagcagcctcttaagagggggagtataattatataagatcatttgatacaaggtggggtcggataaataagtgggtgtgagtaaaacaaaacaagagcgtgagatattaatatgggccgcgcagagggtgcgtagaaagaagttatttgtgcgagtaacatagagaaggatgttgattaattagtctagagacaaattttattatactacaacgcgagggggtagcgtattattttaatgaatataagacggaggaganag

SEQ ID NO: 404636 - DNA, 442 bp, Homo sapiens
tggggggctgctccctggcatctgatgtgttcccaggtgccctggatcccactggaccccttggcgccagacctagcacggtaccctagttacagtcaggcccaggcccttcgctgcacggtgcgggccggtgagatgctctatctgccggctctgtggttccaccacgtccagcagtcccagggctgcatcgcaggtgaagagttgcccaggccacctggggaagagccctgccaaggtccagcagggcctctggggggaggcttgggaggctctaggtcagaagagggatcttcatgctcagatccccgttcttcccacatgaatttctggtatgacatggaatacgacctcaagtatagttacttccagctgctcgactccctcaccaaggcttcaggccttgactgatggagcactggtgaacacgaccaagcacgcc

SEQ ID NO: 404637 - DNA, 743 bp, Homo sapiens
ccttgagtagtggttgcaacattcatgtataagttagttaaactgaaaataaagtgaaacctaataacccattacatgttttaaagttatttcttaggccaggcgcagtggctcatgcctataatcccagcactttgggaggcccagggggtggatcacctgaggtcaggagttcgagaccagcctggctaacatggtgaaaccccgtttctactaaaaatacaaaaaattagctggctgtggtggcgcacatctgtaatcccagctatttgggaggctgaggcaggagaattgcttgaacctcaggggtggaggttgcagtgagctgagatcatgccattgcactccaacttgagcaacaagagcgaaactgtctcaaaaaaaataataataaagttatttctttcacccctaggtgttcaatgttcaattcatatatgaataactaaaaatattcttagccaggcgtggtggctaacacctgtaacttcagcactttgggaggctgagacaggagaagtgtttgaactctggagtttgagaccagcttaggcaacatagccagaccttgtctctactaaaaatcaaaaaaattagccaggcatggtggtgcacacctgtggtcccagctattcaggaggctgaggcttgagccctagggattgaaacttcagtgaaccatgaccgtgccactgcactccagcttgggcaacgtaacaagactctgtctcaaaaaaaaaaaa

SEQ ID NO: 404638 - DNA, 474 bp, Homo sapiens
atttagaattaaataacccataacaagggaaaacttgtcaataatgatactagaacacaaaagaagagaaaatgccaaagattcaacttggttgtatgtaaaagcctttgccatctcagtcaactgagaaatgaccaaactttaagactgttcttaccctaggatatcgttaggagtgtcacgtatacacatcagattcattttgagtcatgttttattcagttcctcacttatacttactttgtgctgtatctactcttgcctgaagaagcaatattgcatgcttaggatttttaaaaaaaattttcaggagatgctgagtgttgctacaaggaggaactgcctttggttcttcactctatgaagagctttattattttataattgcataatgagttcttggaacattgtctttaaaaggacagatgttgtattgtaataaaataatgttattaaaatttgataacctggaaa

SEQ ID NO: 404639 - DNA, 450 bp, Homo sapiens
ggaggtggggaggagggagaggatcaggaaaaataactaatgcatactagcttaatacctgggtgatgaaataatctgtacaacaaacccccatgacacaagttcacccatgtaacaaacctgcacatatatccctgaaattataatagaaattataaaacaacaacaagaacaataaaataaaaacactttacatttgagaaagaatgacaatatcagtaggtaaaaccaacatcaacagttacaagaccatccttccagccaagtaaggcagtcaaaagaggtgtagatctggtagcagaaactgggtccataattatcaaagtggaagttcacagagcaattataactgagaagataaaaactcatgtaacttccattcagtactgcaatttaaaaatagatttttttcacaataactatatacaagataatatatttaacacataa

SEQ ID NO: 404640 - DNA, 216 bp, Homo sapiens
ctgtgataaaatttcagaggtgtttctgtaaaaaaaaaagaaagaaaagaaaaagagaaaaaaagatgtaacattaaatgcgtggtttggtggtttggttgggcacagtggctcacacctgtaatcccagcactttgagaggccaaggcaggaggatggcttgagctcaggagtttgagaccagcctgttaacagagaaagattttgtctctatta

SEQ ID NO: 404641 - DNA, 395 bp, Homo sapiens
agagaccaaggtgttggtgctggagagtcttcaaggccttcaggtaagagctaaaggcgtaggatggatactttccaggtttcttttgtggtcagaaagatgagaaaagatcaaaacaataaacaaactaaacctaaacacaaatgaaaacatactgccaagagtaacaacaaaatattctaccacgccctacaattttccatacttcaaatcttagcctggtaaggacatcagtgtcacattctattatagataagtttctaaaactaaccaggcctagctcatgcctgtaatcccaccactttgggaggctgagatgggtgaatcacttgagcccaggagttcaagaccaccctgggcaacatggtaaaaccccgtttctacaaaaaaaaaaa

SEQ ID NO: 404642 - DNA, 430 bp, Homo sapiens
gagagagacattgatgaggagggagaacctgagtttaggccaggattccaaccgtccgtttcaagagaaaatgttcctgctgaataacaagggggaaacttgaccaggcagggcctggaaattaagatggaagctcgaggttatgagaggccagcgtttcgggtgctgtccaggtgactaggcctctagaggttcttagaaagagaaagcattctgtgtgggactcagtctgggaaacactgcatactgtgttcttgtggagtttcacaattaatgcaaacacattaaaggctcagagaagtcctgcagtaaagaacatttccaatacaaccctgtattcccagcacagatggccacaaagccacttttgttggaagactcgccaaggcaggacatttattaatattttgtgaaagaagaattattttat

SEQ ID NO: 404643 - DNA, 348 bp, Homo sapiens
ttaccatttccgaaaaaagtttttaaaagaaagaaaacacattatgaatctccaataataaaaaacaatgggtattagctgaagagactgaccagtgtaactgtgtcacttatcaatctgttgcttctcagttttgttttgttttggttttgtctttgtttttgagacaaggtctcactctgtcacccaggctggagtgcagtggcatgatctcggctcactgcaacctcctgcctcccaggttctagtgattctcctgcctcagcctcacgagtagctgagactatgggtgcgcaccactgtgactggctaatttgttgtattttttagtagggatggggtttcacc

SEQ ID NO: 404644 - DNA, 468 bp, Homo sapiens
agaggacttcaaaaaaccgtctgaaagagtcagactacaggcagtgcagggtccccagctcctgctccttcacttcctgtctgacttgtaaaacacacataacaagcttcaggggctcaaagtgggagtgtcagggatgaggagtctgatcattaagactggattcatttgggttcagatttcttccccaattcactgattgacaggaatgacataggacaggacagaaaaaagaacaggagaaaggatagttgggagacagacccatataagctgctgctgacagccacttggcccccacttgataggaatgtatcatttatatattaggattgtctcaggcaataaaagtagcatggcttggcagtcagctctgttgttaaaacaaatgcaaatataggcagtaaaatgttttgacttctcaatggtatttggtaataaagtgatgatccggatgatctaaaatgt

SEQ ID NO: 404645 - DNA, 729 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404646 - DNA, 846 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaaaaaagaaaaaaaactctccagcgct

SEQ ID NO: 404647 - DNA, 483 bp, Homo sapiens
  misc_feature (12)..(12): n is a, c, g, or t
  misc_feature (15)..(15): n is a, c, g, or t
gggctgcaggtnttnggacgagggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404648 - DNA, 536 bp, Homo sapiens
  misc_feature (12)..(12): n is a, c, g, or t
  misc_feature (15)..(15): n is a, c, g, or t
  misc_feature (498)..(499): n is a, c, g, or t
gggctgcaggtnttnggacgagggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaaaaaaaaaaacattnntggaagtcgacgcggccgcgaatttagtagtagtagt

SEQ ID NO: 404649 - DNA, 214 bp, Homo sapiens
gtacccctcgctgggggcgaactgagtaacattagggatttcattaaggttaaatttctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404650 - DNA, 269 bp, Homo sapiens
caccaccgcgactctctctcatattagtcttgctactgattctagagccagagactctacactgacttcttagttttaaagacacacacacacacacacacacacacacacacacgctttgggtggtgggaagttggagaaaacatttggggcaagagaaaacaatgaaggcggccaggtatggtggtttgcgcctgtaatcccggcacattgggaggctgaggtgggcagattgcttgagctcaggagttcaagaccagcctgggcaa

SEQ ID NO: 404651 - DNA, 686 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404652 - DNA, 873 bp, Homo sapiens
  misc_feature (835)..(836): n is a, c, g, or t
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaaaaaaaaaaacattnntggaagtcgacgcggccgcgaatttagtagtagtagt

SEQ ID NO: 404653 - DNA, 959 bp, Homo sapiens
  misc_feature (826)..(826): n is a, c, g, or t
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaacgtantacctctttcagaatttttatagtataggtctgcttgccaaggcatttctctcaggtttgcataacatgtgggccgctttggaccagtgcgatcatagactggacaagcgtaatcagtgcggcccgaattgct

SEQ ID NO: 404654 - DNA, 1023 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtggtgagtatccgagaagtgctcccttaggcacgcttgcttagccccatttcctgagggagtgaagtctctggggtaggaatccagtcaataccaagcttggcttcctggagtcttaggagataggaagataggagggccttgacccattggcctgccacaagtaccacagcacttctccacccctacttcttggaccagtctggggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404655 - DNA, 1762 bp, Homo sapiens
gcgcaatcttggctcactgcaacctccacctcctgggttcaagcaattctcccgtctctacaaagtatacaaaaaaattagccaggcatggtggtgcgtgcctgtaatcccagctacttgggaggctggggcacaggaatcctttgaacttgggaggcagaggttgcagtgagctgaaatcacactactgccccccagcctgggcaacagagcaagactctgtctcgaaaaaaaaaaaagaaaacaatgaaggaaaaggagggtgagttagctggagtagaatagaggtatagaatcgttcctaaataaccggctgcattggtttcctggagacttgctaaaaacccagattcccaggccccacttcttggtgctcctaattcagtagcatcacagtagggttccagaagcggtatttttaacaagctcccaggtaattctgatgtgcacctagatttggaaatcactgtgttaaaaaatattgtgaggtaagttggtcagttaggttgggcagcttttatttcattgctaagggatttggacttgatggtgtaataaagcattaattgaacaaatatttatggagcctgtactatgtaccagatgcagactgtgctagcggttggggatacagtgatgacttggtctgcctctaggtggcagggagccattttgggttttcgaacagaaaagtgacataatgaatgctgagttcttaggaagattaatccaggagtagtctccaggatgtactggaaggagagaagctgaaagcagggaggctgctgtgtttgcagttggctgcccagtgctacctctgcagagacaatcaatgtcctgaaggtagctggtatgtctgtgtgcactgacacgagccttcctaccaagccccaggggctccatgctggagaatgcacgtagggctagggtgagcactaacttcacttcaggagagcaaggaacagtgtggctcttccatttttcagttctgtaagcacatcacccttttctcctccccttgagctgtgttctctgacagctgtttgttggtaaagccagcagcccctaaagcacgtcccagccttgtctcctctgtgctttcccccaccactgctgctgcacgcctcatttgctgggccactttagtggtgggaaccattagaggctgagtgacttaaaggagattgagtctgtctcgaccccgagagagagtgggatggatggatgcatcgtctcatttagaaagtgttgcctctgactctaacacactcttctctctttctttacctccctccctgtcttcctcccttcccctcctttccctaacccccttccctccccctttctccttctctctcacagtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttttctgtagggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404656 - DNA, 1763 bp, Homo sapiens
atgcacaacaaataactgctcatacacaagctcttgttctctccatggaaataatagctctacattttatttttgaaaaacagtaacaagtctgaaataaaatagtattaactttttactccattagaaaaaatttaaactggttcactcatcctttctttccatgcaattactgtattattttaaaacatctgagtaaaaagaaatctataatatatccatttaattcaacctaaactctaaatatacaaatgaaggccagggtgagttagctggagtagaatagaggtatagaatcgttcctaaataaccggctgcattggtttcctggagacttgctaaaaacccagattcccaggccccacttcttggtgctcctaattcagtagcatcacagtagggttccagaagcggtatttttaacaagctcccaggtaattctgatgtgcacctagatttggaaatcactgtgttaaaaaatattgtgaggtaagttggtcagttaggttgggcagcttttatttcattgctaagggatttggacttgatggtgtaataaagcattaattgaacaaatatttatggagcctgtactatgtaccagatgcagactgtgctagcggttggggatacagtgatgacttggtctgcctctaggtggcagggagccattttgggttttcgaacagaaaagtgacataatgaatgctgagttcttaggaagattaatccaggagtagtctccaggatgtactggaaggagagaagctgaaagcagggaggctgctgtgtttgcagttggctgcccagtgctacctctgcagagacaatcaatgtcctgaaggtagctggtatgtctgtgtgcactgacacgagccttcctaccaagccccaggggctccatgctggagaatgcacgtagggctagggtgagcactaacttcacttcaggagagcaaggaacagtgtggctcttccatttttcagttctgtaagcacatcacccttttctcctccccttgagctgtgttctctgacagctgtttgttggtaaagccagcagcccctaaagcacgtcccagccttgtctcctctgtgctttcccccaccactgctgctgcacgcctcatttgctgggccactttagtggtgggaaccattagaggctgagtgacttaaaggagattgagtctgtctcgaccccgagagagagtgggatggatggatgcatcgtctcatttagaaagtgttgcctctgactctaacacactcttctctctttctttacctccctccctgtcttcctcccttcccctcctttccctaacccccttccctccccctttctccttctctctcacagtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttttctgtagggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404657 - DNA, 455 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgccgggtggttcactatgagatctgaggaggcttcgtgggcttttgggtcctctaactaggactccctcattcctagaaatttaaccttaatgaaatccctaataaaactcagtgctgtgtta

SEQ ID NO: 404658 - DNA, 612 bp, Homo sapiens
gttacatgagcaacatttgaacagatatatgggaattctgtacaatctatgtgtatatatgtgtatagtgaatgtatgtgcttagtggtatgagttactgtcaaggagaagggctacctagatgctaacacacacacacacacacacacacacacacacacacacacacacacacgtatgtgcttagtggtatgagttactgtcaaggagaagggctacctagatgctaacacacacacacacacacacacacacacacacacacacacacacacacgctttgggtggtgggaagttggagaaaacatttggggcaagagaaaacaatgaaggcggccaggtatggtggtttgcgcctgtaatcccggcacattgggaggctgaggtgggcagattgcttgagctcaggagttcaagaccagcctgggcaacatagtgaaaccccgtctctacaaagtatacaaaaaaattagccaggcatggtggtgcgtgcctgtaatcccagctacttgggaggctggggcacaggaatcctttgaacttgggaggcagaggttgcagtgagctgaaatcacactactgccccccagcctgggcaacagagcaagactc

SEQ ID NO: 404659 - DNA, 381 bp, Homo sapiens
cgccgccaagaagtataatatgcgtgtggaagactacgaaccttacccggatgatggcatggggtgagacagagagggtatgctcgcacccaagtagtgatgggagaaggccggctgggttgggtggcttgactgtgaccctttttcccgaaccttctcgtgacccctcagagtcaatggagtgggtgcttttctctgtggagggaggtgggaggggggtgggtgagcagctgcagctgagaggacttcaattttctccttggctcaggctgtttcctcaaatgaggaagccgaggttttaatggctccctcgaggacccccgaatagcaggagccttccttggctctatccagagcgtcgagtttcatttagattgagca

SEQ ID NO: 404660 - DNA, 820 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404661 - DNA, 960 bp, Homo sapiens
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttatcaaaaaaaaaaaaaaaaaaaaaaaatggggggtttattgtggggggggggaaaaaggggtaggaagggggggcaaaggtttggacagtttttgtacaaggggaattgggggccccaaagggaggataaatggaacgtag

SEQ ID NO: 404662 - DNA, 1036 bp, Homo sapiens
  misc_feature (742)..(742): n is a, c, g, or t
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaacaaagaacaaanaaaaaaaaaaaaagaaattggggggagggaggggccgggagaaggttgtaaggaacaatcggagtgggccgggggcccaagagaggaagagtgaaatgggccaaccgggtacaaggagaaccgggcacagaacgaggggggaattcacaccatacaacgccggggaacacagagaggttggacgaacccagagggagcccggaggcaaaagggggacaccaacagggaccagggagacgaataaacagcgaggagggacgaaaggggaggcacaacacaggaagaggagaagca

SEQ ID NO: 404663 - DNA, 288 bp, Homo sapiens
gcggccgcctactactactactgctcgaattcaagcttctaacgatgtacggggacatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 404664 - DNA, 1082 bp, Homo sapiens
  misc_feature (823)..(824): n is a, c, g, or t
  misc_feature (831)..(831): n is a, c, g, or t
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttacannacacacncacaaagacagaccgagacgtcggagagactacaaaggagagagagacgaggaaaaaacacgagggtacagcaaacagtgggaacccatggcggcagccaaaaacggaacaccgagacaccgaaacaaaccagagagcaacaacagcagggaagagagaaggacgggacacccgaccaaagcagggggagcgacacgatgctaaataccaccacaacgagccaaggtgaaaacacacgacataaacgaaac

SEQ ID NO: 404665 - DNA, 1127 bp, Homo sapiens
  misc_feature (833)..(833): n is a, c, g, or t
ctctatccaacccttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttaacaaagaacaaanaaaaaaaaaaaaagaaattggggggagggaggggccgggagaaggttgtaaggaacaatcggagtgggccgggggcccaagagaggaagagtgaaatgggccaaccgggtacaaggagaaccgggcacagaacgaggggggaattcacaccatacaacgccggggaacacagagaggttggacgaacccagagggagcccggaggcaaaagggggacaccaacagggaccagggagacgaataaacagcgaggagggacgaaaggggaggcacaacacaggaagaggagaagca

SEQ ID NO: 404666 - DNA, 871 bp, Homo sapiens
atgtatggacacccagacttacacagggagagctgacggccttggctgcacctaaggggacacacactgacccctcaggaaatcctgctggtcccgtccccagggtgggaaaggtcaacaagggaaggacgtgatgacgctagcctcacagggaatgccctccccttcctcctcgggtcacacaggctggtgtgcactggcctctctgactcagattcccgaaggaaggattgactgactgcctcttctataagagccaacctccaatctccatgtgagtgctctgcaccagccttgagtgaagcagatcccaggcccctttgaggaaaggcaaaaatcttactgcccaaccccctagcagtgcctctgagcttgctccacggggtacagggaaaggggccgactgggccggaagggccccagcgaaggaggcacacctggtagttccatttcctgactagcaacttccagcccacatcaattttaaggagtccagaatatttgtagtatgcaaaaaggggcattacgaaacttttaaaagtctgttttaattataaaagtaatatatgcacatggttttaaaaaaaatgctggctgggtgcggtggcgcatgcctgtaattccagcactttgggaggccgaggtgggtggatcacgaggtcaggagttcgagaccagcctggccagcttggtaaaaccccgtctctactaaaaatacaaaaaatcagctgggtatggtggcacgtgcctgtaatcccagctactcagggggctgaggcagaattgcttgaacccaggaggcggaggttgcagtgagcagagatggcgccactgcagtccagcctgggcaacagagagagactccatctca

SEQ ID NO: 404667 - DNA, 219 bp, Homo sapiens
ctttcctatccttcccaaaaaggaaaccaaattaagtaacaaactgaaatttaaaaaggatgtgagttccctgtaaggggaagtagcgagtctaaacttcagggtttgttgttgttgttgttgttgttttaaatagaatctctctctgtcactcaggccgagattgcaccattgtactccagcctggatgacagagtgacactccatctcaaaaaaaaa

SEQ ID NO: 404668 - DNA, 598 bp, Homo sapiens
gcacgtattagatactcagtaagtacatttgtctggggctaaaccttcagggtctccaggaagtctttctgagccccagagtcctaaaaagcccaggtgctgctgaggaataataactgtatcatcctggggcggagggctgctgcctcttcccagctggggtttcagcctctgccctgcccccgcaccagccggcccccaacctgaagcctagagcatcaaattattattgcctccgggaatgactgggagccttaggcacaggtgggtccttggagacaggggatggtcctttaacagtgttctggatcctgatggagaagagagggggttctcctctgcccacactgaggcacactcggcttgtggaggaaaacggctgactagtgcccccagcttcaagcaggcagagctgtcagggctggtcgtgtgggttggactttctcctccaagaaagctcagagttgtaaatacctgtttctcatctgcggtgtctagggttgcctggggagtcaaggcatcagggagcaggacaggctcaggcccttcccgactgacattttccagcctatggggggccttggctagcctggtggct

SEQ ID NO: 404669 - DNA, 453 bp, Homo sapiens
cactgatagcataaacaattaaaaaaaacttcatcaataattggaatgcaattagaatttttatcctcttgagtttatatgagatgcttgtggacttgagaggaaatatttacaactcatcagtgaaccagcaaaccagtggccaaaatttaattaaaagtttacattggtccgggcacggtggctcacgcctgtaatcccagcactttgggaggccagggtgggcggatcaccagaggtctggagtttgagaccagactgaccaacatggtgaaaccccatgtctacgaaaaacacaaaattaaccaggcggggtggcggatacctgtaatcccagctacttgggaggctgaggcgagagaattacttgaacccgggaggtggaggttgtggtgagccgagatcacgccattgcgctccagcctgggtaacaagagtgaaactctgtctcaa

SEQ ID NO: 404670 - DNA, 474 bp, Homo sapiens
caccctctgtcccagccagaatgcagttagaggcatagtccttgaaatgattttaaagttatgcctacattttcttttcttaattacaaaagttgtatatattgagaactcctgattagagcccccaggctcttagcttccccgctatggccacagaaaagcacaaggtcaagcagaaatccataatctcgggctgagcgtagtggctcatgcctgtaatcccagcactctgggaggccgaggtgggtgaatcacttgaggtcaggagttcgagaccagcctggccaacatggcaaaaccccatgtctacaaaaaatacaaaaattagccgggcatggtggcacacgcctgtagtcccccctacttgggaggctgaggcacgagaattgtttgtacccaggaggcggagattgcagtgagccgagattgcgcccttgcactccagcctgggtgacagagtaagactctgtctca

SEQ ID NO: 404671 - DNA, 460 bp, Homo sapiens
ctttatagcagtgtgagaacagactgatacacagtctgctcagcgagatcaatcacttctcacataggaaaagcaaatgagaaatggaagtggacaaatggaaacctgagacgggacaggaaaaggatgtttcttcctacttttctgggctataagaatggattgaaaacgtagaaaaattgaagcactttcaaagggaaaatgtagggcaataaaggctttcctggtgccatttaatcatattttatatacagaaacctgctataatttcgtgattatttgttgttttaagcagcctctgttgtcttgccttttaaaaagtagtcattcatggctggacacagtggctcatgcctgtaatcctagcactttgggaagccaaggtgggtggatcatttgaggtcaagacttcaagaccaacttgactgacatggtgagactctgtctttactaaaaatac

SEQ ID NO: 404672 - DNA, 659 bp, Homo sapiens
tttttttttggtggcgtggaggggaatgagatatcctgttattccagtgccacttgtggaaaaaattaccgtttttccttgtctctgctcctttgtcaaggatcaatttactatattcgtggtctacctatgcgctattttgcttcaatgatctatttattctttcaacaataccacaatgtcttgattactgtggcttcataagtctttaagtacaatagtgtcagtctgactttgttctcctataatattgtgttgcctagtctaggtctctgaccaatataaactttagaataactttgctgatagccacaaaataacctgctgcgattctgaattaaattacactgaatctatagatcacgttgggaagaacttgacatcttaacaatattgagtctgcctaagcatgaacatggaatatctgtttatttagatcttcgattttttatttttgtcattttcctcgatcttgtacttatgttgcaagatttatatctaaggactttaatttttttgtgctaatataaatggtattgcaacactgctatagtcttttattttttttggagacaaagtcttgctctgtcacccaggctggagagcagtggcgtgatctcagctctctgcaacatccacctcccaggttcaagcgattc

SEQ ID NO: 404673 - DNA, 714 bp, Homo sapiens
ggtttccctgtctcagacaactgtgctgtgaaagtttcttcagtgcatgatactggcccccctcctgcctctggacagaagcctgtcattattgtcaccggtgaggagacatttgtcccccatcacgcatgagggacggagaagagaactcctggcattccacaggggatggagggatgggggtgcagagccacccgctggccctcagccctgactcccagcctctgaaaaacaactctacgacaaatcctccttctgagcctccactcagtgtgcacatgagtggctcctgtcagcgggagctccatgggaagcttctaaatacggaaaaagtggaaatggcatgttgccatgcaaatgtggccccactagacgtttgtcccaaaatggagcatcctagagtacccattcttcatctctgccttgggaagatgttcgcccaagcgcttgcttgatttgcagatagaaacgttgtccccactcttgtgtgcagttcaaagacttcacacttgacaactgagagtccaccaaagggagaagtcggaccagcccccagccaaacacgggagaaaataaggacttaggaaaaccagcactgaggcctggaggcctggagctccaaggggcaggtcccatgagcatcccgttccacgtggttttcaccagcttaagtcccatcattggcacattccttctgaaaaaaaaaaaaatcaa

SEQ ID NO: 404674 - DNA, 287 bp, Homo sapiens
gcggaagggatggaagaggctcatttttataaatagacttctaattttgttctgtgttatctcccttttgctatatttagtagcttctcaggatcatcaaagaactgaaaaaaaaaaaggcaaatgagaagaaggaaggaagggggtaggaagggaggcacagaaggatagaaaaggaaaaaaaagaaaggatgaaagaaaggaaggccccaaggttggctgacttttgctgggctggaatccagaatcactgtatgagaggagaggtggaatgctggtccccaaga

SEQ ID NO: 404675 - DNA, 328 bp, Homo sapiens
ggtgctttggctttgtaaagaatttgcaaatcacttaacagctgcaggggcaaggggagagtttcatcatccccatgatatttgggaatattctgtttacttcttagatagttaagaatgtattcagctactatgtactaacttgaaccgtgtttaaggaaaactcctatttcatcctcttcttgcgccatcccctctccctaacttggtaatgtgaagaaactaaaacctgataccacagctcctataggcattttagagatcttggatttttatgtacagtcttagtcatttttaataaatgtggttcagtaagggaacggacata

SEQ ID NO: 404676 - DNA, 1039 bp, Homo sapiens
tcctttaatataaaaatctttattaatggaataaacaagcccctgtaattttatttatcaacgcttacagagcgcttactatgtatgcaatgcatgatttcaagagctttgcaaaatataatctatttaattttcacagcagccctacgagagaggtacgattattatcccattttatagatgaagagactgatggcagaaatgccaaatgtaataggaaacagcctttcttcatgcattccacaaatattggctcggcgcccgggaagctcatcttccacgatctgtacttccggaggagtcccagaggaacacctcctcagttcagaggagtcaagggttacagcggtgccctctcccatcactactcttttcccttcaggcgccctaattgacattcgatttgtagccatttgcacaatgctaagtgacaggcttgggctgcacacaggaccaggccgtcttccctctcctggggatcagtcgttcacagaaccaaaaacaagttgcatggacgcgcgcgttggctgcagattttcttcacagccaggagaaagagcacgcgctctccagccccgcctcttcttccgggacgacgaattgcggggctcggattgggctgaggcgggccacgcctcctcatatcctccaatcaactccctctctggtgcgctccctccttctcagccccgccccaccgccccacgttacgtcgctccttctggcctcctccgttatcccggcggctgcggctcgcgcggcaaacccacctcccattgcttcccattggctggtcaggtcccgcgcgagcgggatcgcgcccttcgccccccacccccaaaaccgggccatgcctctctccttcggctttctccaggagccagcgcgaggcagtagatcggctgcttgagacgcgcgcgcagctcctgcggaccactccctccgccctgcgccagcagctgcgccggctggcagccccccgcgcacgcgcgctcgcccatcccgctccctctgctcgtttgcaagtcgcctcgcgctc

SEQ ID NO: 404677 - DNA, 1972 bp, Homo sapiens
cgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgttcctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaaccagtgtgtgtatgtgtgactaagacattccccatgatcttaagcagcaacattgtgtttcaactaaagatacccagttttgaaagattcagggagaaaaaaaatcccgatgattgcaataagggccatgaaaatgccactcacacagaatctcacttttcaacatacttagtagtcctgggtggaaccacgtttggcaaaaccttcactaattaattgcattccttaaactattaaacatccattcatttatttcaagatttatggagttctctgttcagatacaatgtctttgtcccctagtaaacagtgacacagcctcctcacctaccttcttcttaattagttcccatgagaacacttttttccacacttattaggatgtaattgggcaaggtgggatccactctccactgagctcagccctggtcccgacactgtcgctgttaacacctcaccttccgtgttgggtggcccctgggggttccaggg

SEQ ID NO: 404678 - DNA, 1483 bp, Homo sapiens
cgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgttcctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaacca

SEQ ID NO: 404679 - DNA, 745 bp, Homo sapiens
atcgtattttaaacttgagttcagacttagaccttatgagttgaaggtgatttcctgccttactgagtttttctgttatcagacctataatttgtttacactatactcttctgatattattagtagtagccaagattttcttcactcttttcttggaaaattggatagaactgttaaggtacagccttctgggttcttactgtccttgaatcttttcatttcttccttcctccctttcctgttgcacactaatgaagatggacatgaaatggacgtgaaacattaggcaaggcaaggcctgacagatttggctggtaaacaactagtcaactttttgaatttagacagttattaattacttaggcagagaaaaaagtagtccaaggtgccatttctctgtgccccttgtctcacacttgaaaagagtgacaccgaaataaaaggggctagctaacgattgtcccttgaatggtgggacaccctgttgctgaggaatcattgttatactgcagctaagcctgtttagtctgcaaatgtaccctacaaggttgaggaagaaaggtctcatgtttcattagaacctgagaggagatgggaaactctcctgacagaagcatcctggggcaagagagaggtgagtggaaaacgtccatccatatagcaacttctcacaagcctctcttgtccatgttccaggatgattccatggccttctgccaagacagcttgcactgtgattcagacc

SEQ ID NO: 404680 - DNA, 467 bp, Homo sapiens
tgctttcttagaattttcatctgcttatacttatctgttctttcatgtccttttttcattaaagcctttagcttattcatcattttcaaaaattttcttgtcgaatgattccaatatttctgctgtatctgactatgattctgatgcttgttcaatcttttcacactgtgttttttgccttttagtatgtctggtaagtttttgctgaaagacggatgtcatgatgtactgggtaaaaagaattgtgaatgggtctttagtgatgtggtggtaaatcactggggagtgatactgtttggatgttttgtcccctccgaagcttatgttgaaatatgacccccagtgttggaggtggggcctggtgggaggttttggatcatgggggtggacccctcatgcatggcgtggtgccttccccttggtgatgagcaggttcttgctctgttagttcacacaagagctggttg

SEQ ID NO: 404681 - DNA, 384 bp, Homo sapiens
tgtctgaaacagtctcactctgttacccaggctggagtgcagcggtatgatcttggctcactgcaacctccatctcccaggttcaagtgattctcctgtgattatgaatgttagctcttttattattgttctaaagtttcctgaaatgctgttaaatttttttttatcggttttcttcttcttgttcagacagtaaattctgttggcatgttttcagattcactgattccatcttctgctctgtgctctcttcttttgtgaccatcctctgcatctattatttccattattgtattttaattttatttagttcatgtttactttttataacttataagtcattattgaatttatttttaattttaacttttatttgttccaaga

SEQ ID NO: 404682 - DNA, 468 bp, Homo sapiens
  misc_feature (465)..(465): n is a, c, g, or t
agaaattttgcattgtccgtattagaggaggggtggattggcatctagtgggcagaggccaggggtgctgctaagtaagcatcttacaatgtacaagacacgccccaccacagagaatcatccagccccaaatgtcaactgtgtcaaggctgaacaatcttctccttgcactgcttcccctctccactgctagtggagcctgtgactgcggcagtcctgcaattctcccccctccccccacttttttttaaagatgaagtcttgatttgtcacccaggctggaacaacctccgcctcccgggttcaagtgattcccctgggaggcagaggttgccatgagccgagatcgggccactgcactccagcctgggagacagggcacgactccatctggtgaacatttgctccccttcccttctaactgtctcataaggtttccagtgggaattgcatcttcttggcggncgc

SEQ ID NO: 404683 - DNA, 770 bp, Homo sapiens
cacaacggatcatacaccagccacccagccatcccaagccagccacctggtggccttcctgagggttcatctcctctgtcttggtcccgttcacacctgctccatgtctcttcgtccctactgccacctccctcatttagacatccttcattttctgcctgaactgccagcaaatgctctttgccaggtttctgcatttaggcctcacctcctcctgcctttctgctcccacatcccactcagtccccactgctggcagagaaattatgccagagccgaatatcagctctcaactccctttagctctctttagcttatctggggtggggaagcaaatcagaagtaatctttgtcaagacagtagaaattgtggcacaatttttttttcacttgttcagacaggtggatggaattatggagggaaaatgtacaatatatttctgagtgaaatagggaccgaacacaataccttggtggacagttcagtgatgttggtgaatgggatagaatataattccaaagagaggcagtggctatgagcaaaactgctaaaacagcggcaattgcttgcattattctgtacatttctttttgagggtgcagaagtgggaaggaaggcagggttaggagtgattgaaaataaatgagagaggccgggcgcagtggctcaggcctatattgccagcaccttgggaggctgagtcgggaggatcttttgggcccaggagttcaagaacagcttggggaatatctggagaggcctcctctta

SEQ ID NO: 404684 - DNA, 479 bp, Homo sapiens
aaactgaaaaaggatcaagggaaataagaacccaagagtgggagaagattacatcatacagggcagagagtcccaggactttctcagtaagttcagaatacccccttagagcagaggaggcacacaggcaggtacccaaacaagaagtacttttaatggtggaaataatagaagtaaggacttcatagagcctattgttagagtctttcacacacagccctgaaagtttgctgacgcttgcctccataggttgattgtccctgggtctctctaacctttgcaggaactaaagtgtatgaagttgtatggtactgagaatagtctataatttgatggctcttgtttattaggagacaccaatatattttgatttttttttggtcaagttttttttttttttttttggtcattctggatatttgtcttatattaatcccagtatttcctgttttaccatgataataaattcttcctgtagt

SEQ ID NO: 404685 - DNA, 415 bp, Homo sapiens
gagcgacagagtcagactccatctcaaaaaaaaaaaaaaaaaaaagaaagtatgagaactccctggaaagaattcatgctaaaggtgcttgttcagctcaaatacaatggatcagaaatgaggggtggccaggcaaagcagcttacgcctgtaatcctagtacactgggaggctaaggtgggaggattgcttaaggccaggagtttgagaccagactgggcaaaatagtgagactctgtgtctacaaaaattttaaaaattagccacgcgtggtggctcgcctgtggttccagctactcagaaggctgaggtgggaggattgcttgagactaggaggtcaaggctgcagtgagctacgattgcaccactgcagtacagcctgggcaacagagcgagaccctgtctcaaaaaaaaa

SEQ ID NO: 404686 - DNA, 230 bp, Homo sapiens
cagtaaagctgttacaaaaaaaaaaaaaaaaatacaggtttttatgaattagcccaggacagcgtattgcagggagcttttcacactccctatgagggaaaagagatacaagttaaaacaaaactgtgttcttaaagtgtccctaatcctgcttgtaaaataagaagacagcatatataaagcacaaataatattgtcctcacaaacatcaccccaccccaaataattta

SEQ ID NO: 404687 - DNA, 174 bp, Homo sapiens
caatgttcatctcacatgtgttgattgatgtgtcataactccctaaagtgtataaaaccaaactgtgctctggccaccttgggcacatgtcttcagggtctcctgagctatgggtatgtcacgggcatatgttctcaacctgggcaaataaactttctaaattaactgaaacct

SEQ ID NO: 404688 - DNA, 352 bp, Homo sapiens
taaaacttgcagttattctgtaacacatccccagtctctacatgtatctgaattttacccacacttccacagatttaactaatttctcctaatgtttgcaggacaaaactaaggaaatgtctagaccctcagggtaagggaagcccctagagaccggcatgtgaatcacaaactcaaatgcttatggaccagacaggtaacctcaatgagtaaggtgggccaggtgaggatgttggataattggaggacgcacattccatttaaaggtgatggctactgctcaactccagccatctgtgacaatacagatccaccatgtgctgctagatcatcttatctttcaaagaaagca

SEQ ID NO: 404689 - DNA, 2070 bp, Homo sapiens
attcttatctcataagcaggacattcccgttctaaaccacatgtgatcgccttattggaacaatggaaagagcctgaagtgacagtgaggaaagatggaagaagatggtgcacagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggaaaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaaccactgctg

SEQ ID NO: 404690 - DNA, 2624 bp, Homo sapiens
tattcctgataaagtgacattttattttaaacatggataggataagaaagctccagtctacaaacaaaacatgccagaagatttttaggcgatgatgccacctgcacatggaaccaaaaggtgagaaaatttgtaagaacgtcaaggtgctaaaagggggaaattaggtcagtatgggacagagggagttgtgtcttgatatgaggtctgagaggtgagcagggacaatattatctgtggaaagatacatggattttaatgtaagcgccacaagaaacccctagaaggaacaataaaatatggattataaaaatttcatctgcatcagaaacatttgttagaaaggttgacagtattgatgtccaggaacttcccctatgtctgattcagaggggcgggatgctgcttgaacatccattttttaacaggctcttcaaagattattatccacacctaaatgaaaactgtttcactaatcaccaaccttactattttacataaacacttgttaatctctgcattcctttttttttttttgaatttcataatggtgttttaatattactgagctatttatttctagttggtgttattttcagtttttctcttttcttccctagaattttttttcaaatagaaaaataagatatttttaaaattttctttcagatttgcagttggaagatgatacaatcggctgtaaagaaatgcccacctctgaaaactgtccatcttttgctctacatcagaaaataagtagacagaaaccacgtgaatgtcaggaatatggaaagaccctttgtcaagactcaaagcctgttcaacatgaaagaatacatagtagtgaaaaacccaacagatgtaaagaatgtgggaagaactttagtaatggacatcaactcaccatacatcagagattgcatgttggtgagaaaccctataaatatgaaaaatgtgggaaggcctttatcagtggctcagcctttgttaagcatgggagaattcacactggtgagaagccactcaaatgtaagcaatgtggaaagactattagtggtagctatcaacttacagtacataagagtattcatactgggaagaaaccatatgagtgcggggaatgtgggaaagcttttctagtatatggaaagcttacccggcatcagagtactcacactggtgaaaaaccctttgggtgtgaggagtgtgggaaggccttcagtaccttttcatacctggttcaacatcagcgaattcataccagtgaaaaaccttacgaatgcaaagaatgtgggaaggcctttagcactagctcaccccttgctaagcatcagagaattcatactggcgagaaaccctatgaatgtaaggagtgtgggaagtccttcactgtgtatggacagcttactcgacatcagagtattcatactggtgagaaaccttttgaatgtaaggaatgtggaaaggcctttagacttagttccttccttcatgcacatcagcgaattcatgcagagataaagccctacggatgcaaggaatgcgggaaaaccttcagtcgtgcctcatatcttgttcaacatggaagacttcacactggcgagaagccctatgaatgtaaggagtgtggcaaggcctttagtactggctcataccttgttcagcatcagaggatccatactggggagaaaccctatgaatgtaaggaatgtggcaaagcctttattagtcgccatcagcttaccgtacatcaaagggttcatactggagagaaaccctatgagtgtaaggaatgtggcaaggccttcagagtgcacgtacatctcacacagcatcggaaaattcatactgatgtaaagccctatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaattcatactggggagaaaccctatgaatgtaacaaatgtgggaaagcctttactgtttatggacaacttattggacatcagagtgttcacactggtgagaaaccttttgaatgtaaggaatgcgggaaggcctttagacttaattcattccttactgaacatcagcgggtacacactggtgagaaaccctttaaatgcaaaaaatgtgggaagacctttagatacagttcagcccttaaagtgcatctgagaaaacatatgagtgttataccctaagagtctgaggagtgtgggaagtgcttcgtgtgtggctcaaacattgttgaacatcggggaatttatgctggtaggaaactttcaaatgtgaagaatattggcaggtctattctcatcttataattcataatataactcagaaaacataagaatattcctttgtcatttataggtttgtaataccaatatttatactggtggaccattcagaaaaagtgggaaacgttattacttaatggttacagcactgacagcatgaacttttatatgatgcatttattctaatgtgattgtatgaacaagtgaataaaaaaccttggacctcctaaaccactgctg

SEQ ID NO: 404691 - DNA, 2098 bp, Homo sapiens
  misc_feature (54)..(54): n is a, c, g, or t
  misc_feature (131)..(131): n is a, c, g, or t
  misc_feature (455)..(455): n is a, c, g, or t
  misc_feature (812)..(812): n is a, c, g, or t
  misc_feature (814)..(814): n is a, c, g, or t
  misc_feature (917)..(917): n is a, c, g, or t
  misc_feature (1351)..(1351): n is a, c, g, or t
aatgagtcagggtctccctctgtcacccacactggagtgcagtggtgtgatcanagttcactgcagcctgcagcctcgaactcctgggctcaggcaatactcccacttcagcctcccaagtagctgggacnacaggcacacttcaccatgcccagctttttaaaacatattttttgtgaagatgcggtctcattatgttggccaggctggtctcaaactgccggactcaagtgattctcccaccttgttccccaaagtgctgggattacaggtgtgacccaccttgcctggcccggggtgtcttttttttctgagatggagtctcactctatcgcccaagctggagtgcagtggtgtgatctcagctcactgcaacctccacctcctgggttcaagcgattctcctgcctcagcatccccagtagctggaattacaggcacacaccaccatgccnggctattttctgtatttttagtagacacaaggtttcaccatgttggccaggctggtctcatagggtgtctttaactagcatggaacccacaaggtccactcattcatttttgtattacctcccaggctcagcatggtgcctgaacctctataaggaggcaatgtgtgttaagagagacaggaggggtcaggtgcggtggctcacacctgtaatcccagcactatgggaggccaaggcaggcagatcacttgaggccaggagttcgagaccagcctggccaacatggcaaaatcccgtctttactaaaattgcaaaaattagccatgcgtggtggtgtacgcctgtaatcccagctantnaggaggctgagacatgagaattgcttgaacccgggagtttgaggttgcagtgagctgagatcgccccactgcactccagcctgggtgaaaaaataagactgtntcaaagaaaaaaaatttttttttttgtagagacggggtttccccacgttgcccaggctataactgtactttaaaagacacaatactctagagatgtcattacagttagtagattattatcttaattgaccctaaattcgctattttggagctaagcaaccaattacggcctggtggtatattcacctgctccttagatggaggttctgtgaaggcagcagctctgtccatgttgtttactgtagggctgaacactgaccttgagacatagttggcactcaaaattatatgttgaatgacagaattttgattaggtggatctaacgcatttgaaataattcatagggctgggcacggtggctcaagcctgcaatcccagcactttgggaggtggaggcaggcagatcgcctgaggtcaggtgtgcaagaccagcntggccccagcctccctagtagctgggattacaggcgtgagccaccctgcccggccaagttttacattattaagctatccatgttctcttgggaactgaactttttttcctcttgatgctctggatttgacattgcacttgactttttatgtagtaactgacatgtgccagagttggcatcttcccccaagtccaagcatcatgagtaactcttgcttatctctctctctctcttttttgagacaggttttgctgtcacctaggccgcagtgcagtggcgtaatcatggctcattgcagtctcaacctcctgagctcactcaatcctcccacctcagcctcccatgtagctgagactacaggcacgcaccaccacacccagctaaatttgtttatttttgtagagactagatctcactatgttgcccaggctggtcttgaactctggagctcaagcgatcctcctgtctcagcctcccaaaatgttggcattataggcgtgagccactgcaccctgccttgcttatctttatagattcaaatggtaggcatttcccatcacctaattcctttttttgttattgttgaatagggtcttgctctgttgcccaggctagagggcagtggcccaatcacagctcactgcagcttcaatcttttggactcaagtaatcctcctgcctcagcctcacaaagtgctgggattacaggcatgagccaccaggcttggcaagtgatgacatttttta

SEQ ID NO: 404692 - DNA, 372 bp, Homo sapiens
gtatgaatgctttgggttaaaaaaaaaaaaaaaagaggtcctacctatgataaagcttttaaaaaaaggccccaaattatatgcatactggaaggaattttttttttttttttttttttgattaacagagtttggctctttttgcccaggctggtctcatagggtgtctttaactagcatggaacccacaaggtccactcattcatttttgtattacctcccaggctcagcatggtgcctgaacctctataaggaggcaatgtgtgttaagagagacaggaggggtcaggtgcggtggctcacacctgtaatcccagcactatgggagcatgcatttcagtgaaagtttagaagaattacagtgatatcact

SEQ ID NO: 404693 - DNA, 553 bp, Homo sapiens
cgagaatgtaagtctttcccaggaatttaaaaatgataaagcaagccgaaaaactgtagggaggaattttcattttgttaaatttaggttgttaggggaatcaacgcttatggttagacctctgattcaggaagtctcaaggatttacattcctatttcagaagattgttaaagcaaaaacgattgtcatttgcagttttgatacacctctagttgtcagttcaactttttacctttagttttctctgaactcttccccttgttccaaggggaagctttcaaaaagtgaattatgtcaccatttgcatgttattgaatagaagtgcactcttaacatcccatttatccagtgtcaaagctatgatacattgttgctttatgtggggtctcccacactgaaaagaaaaacccggacttcatttatttatttatttatttatttatttatttattactttatattgctaatgtaaacctctgctagaagtaaataggctctcgcaaatattcaaagtgatacagtaataaacatcaaatatgtttgagaagacta

SEQ ID NO: 404694 - DNA, 471 bp, Homo sapiens
tcatccgggtgcatccctagtgctcaccatgctgcccaggcaccctcactgagatgagaactttccttgttcccctcccctaataaccaaagttcctgccttaatcccactccagtccctcatccaccccgaggccaggcttcagaacccagaactgagggcctgtccagccctgctttccttgtgtttgagggaagccctgatatcttggagctgtacaaggtagcaacataatttgatttccctggttgctcatcggaggataagctgtgggaggcagttgggcagggcatgcaggcagatgggacccaggcctcaatgctgtcacctcttagagaggataaggtgggacgggcatggtggctcacatctgtaatcccagaactttgggaagctgaggcaggcagattacctgaggtcgggagtttgagaccagtttggccaacatggtgaaaccccatctctactaaa

SEQ ID NO: 404695 - DNA, 515 bp, Homo sapiens
aagttggaaaagtaacttgggatgtggttgagaagggaattgagtttatgctctatgaagcacagttagatgtctgaatttaagaagaaatcttgtaactgcagacatttatttgacagggacaagaaaaatgccagaggcacaaaaaccaattaggcttttgattaatttactcataagataataaggatgtaagacagaagcagtggacttggaaaggaagggcaagttcagggggccaattaaatacaatggatacaagtcctgaaaaaaacaggtttccaagcccagacttaaaaatagtttcttatactgtaataggaactgggctaaggtatttttgttttgttcctgagataatttcctgcaaggatttaccatttcctgtttaaatctctagatagtttcttgtattgtattattttgcacacaattaaattacattctttttttgttttttgtgttttgttttgttttgttttgttttttgagacagagtctcactctgttgccca

SEQ ID NO: 404696 - DNA, 391 bp, Homo sapiens
acacaatcggggctcaggtgtctgggggcacagacacaacaggttgcctagatccaggtgtgtgtgcacacaactcacgcaagaaacacctgcacttggcttgtaggagactaaaaatcccaaacatgctatacctactaggtttggggacaaagtaaaagtgaaaataatctcgctgataagactaaggtgtcttcccagatctgatcaggagtccaatgtgaataggagacaacagagagctgtctttgtactttggctctgaggaaggtttgtggaatggaccgcgtgtggcctgagagagctcgcatttcagggaatgcctgggcttgatgcctgttatcttgttcagtgcctctgataaattaataaactggaatctcactcaaca

SEQ ID NO: 404697 - DNA, 365 bp, Homo sapiens
cagatcatccctatgataccaggtggaaaaatggatgctcagagtggtcaatcaactcacccaggaatcccgcaggcagatggaagtggcaaaaccgcgtcaaacccagattactgactttaatgttggtccgtgcacgatacccccccccccccgccctggttatttggccgccttcgccggcagctcagggcagagtctcctggaaggcgcaggcagtgtggcgagaagggcgcctgcttgttctttctttttgtctgctttcccccgtttgcgcctggaagctgcgccgcgagttcctgcaaggcggtctgccgcggccgggcccggccttctcccctcgcagcgaccccgcctcgcggccg

SEQ ID NO: 404698 - DNA, 929 bp, Homo sapiens
gccagaagggggagtttcagaggcttccacttggatttccccactatgatagctcttacctcacaggataaagggcttgtgtcaattactaagtatgtcaattacagttatacatttggagaccactgacggtgggaccatggactgtgggtgagctggacctaagctagaactccatttatcacctggctcccttaggaggggccatgctaatgctctgggtttccccttccccagtacacagttatctgagtaacgctgggaagaaatggaggaatcctcgctgtgtgcagtcatggggttcttcctcctggggacataggctttctgtctatcaagtttccacgtccaagaacttgctcagggatggacattgcggaagggatttttacttttttttaaattaaggtgactgtccttagcttcccagccatccatccgtgctgtttttgattatgcagatacagtagtatccttattggctccatatctatgtggcccctaggggtgccaagttctattcactccacaggtctctgtaggtcaggctcccctggcctcctctctaccctaccactcaccacaatgacatcttcctgccttctgatggtgccatggtctgaatgttggtgtctccccaaaattcatacgttgaaacctgaccaccaatgtgagggtatcaggaggtggggcctttggaaggcgattgggtcatgaagatggagcctcatgaatgggactagtgccctaatgaaaagatgtcccagcatgctgccctgcctgttctacactctgaggacacagtgagaaggcaccatctatgagccagaaagtgggccttcagcagacaccaaatctactttgatcttggacttcccggcctccagaactgttagaaataaatttctttataagccaaaaaaaatatg

SEQ ID NO: 404699 - DNA, 506 bp, Homo sapiens
attttattcagatttctttagttttttgcctaatgtctttttctgttccaggatcccctccagaataccacattacagttaattgttatgtctccttagtctccccttggctgtgtcagtttcacatactttctttgtttttgatgatatagatgtgaagagtactagccaggaatattataggtattgggttttttaaatgtatgtgtcatttcatgattaaaaatcagttgcggccaggtgtggtggctcagcactttgggaggctaaggtgggaggattgcttgaggccaggagttcaagaccagcctggccaatgtggcaaaatcccatctctgctaaaaatacaaaaaatatagctgggcacggtggcacacacctgtaatcccaactactcgggaggctgaagcacaaggattgtttgaacctgggaggtggaggttgtagtgagccaagattgtgccactgcattctagtctaggcaacaggtgagactctgtctcaaa

SEQ ID NO: 404700 - DNA, 706 bp, Homo sapiens
atttgactgcagtattgccagctgtgattaggtggagttgtctcaaccctttcgtgtgctctcttctctccactggcttggttgtggatattatcccttgcttttaactaaatcagtcatattttctgggccataattccaaattagaatgcacaccttcatccaggtattgcaatgcttcaacctgacaggtatgcccattatggcagtaggtctctttctccatttttacttattaactttacattcttagttatgtctgcctctgtgtaactgtcgaatgatcatgccatgagaagttccccaggatggtcagtagttaggaaatttgacaagaataatcagaaacttacaatactgatggagaaaacatttcagaacaatatattattctgaaatcgagacattctgtagtataacaacaggggcctgacagttaaaaagtgtgtccaacatccatatcatttcaatgaggaatacttcaccagatttaaaaaaaaccccagcatgttagaaagcctcatatagttcttaatactccataattgacacttaaaattgtcttgtgaaatgacttactatgtttaaagtgcttagtaaaataaatatttcttatttcttcatctggaaatctgtaggtaaagtgaatatgcacagtaattattagctaatatgatgctgatgctcataatggcctttcatttag

SEQ ID NO: 404701 - DNA, 412 bp, Homo sapiens
cagtgatggaaatgctctaaagttggattgtagagatggctgcacagctcagaaaaagtactaaaaatcttttaactttatgttaaaacagatacattctatagtatgtaaattatatttcaacaaagctttttgattttaaaaaaaaggaaaaatgtgtttattacatcagcttagaaacataccttgtttccatagaggtgagagatgatttactttgagagaagactttgtgtcacctatgacattttattcggcacagagtcatattttaaggtagatagtcctgtagtgctgaaataataattttaatgtctttatgttgccacatgttaagaccatgatgaaggtataaatggaaatgtttacacctgaaatgagtattttcaaattaaaatttaattaagtgatt

SEQ ID NO: 404702 - DNA, 564 bp, Homo sapiens
tatttctgagatcagggtttttcaaactgtatttcggcagcaggtgtttcttcttctgtaagaaacagatctgggaactcgatgaatcagagagaggaagctgcagcgctggccaaactggggcctggcccacatggctgcccagatccccgacaacactgtcaaccgctaacagtgctgggagcaggcttcatcccacggcggctgtgcctaccctctctacaaagccgtgcccacctgcaggtaggttctgtgaatgtgccccggcaccgtgcacatccctggatgccgccggagtttactgattcgactgcaacacctgaaccttgggccccagctctacccattggctccccacagaatgccctacatcttagaggatggtaaaacattgtcctttggcactaaaagactactttgagaaagctaccctcctaaggggaatgtggctctccgctctgatgaaatacccacttttacttaacttcttttctcatgactttctgccaaattttcactactctatatactgaaagtagtaaaattctccaaaatctttataaa

SEQ ID NO: 404703 - DNA, 459 bp, Homo sapiens
ttcagaatctctgcccttgggtgtgggcggcacctatgggagttctttaaaatcagtccacgggtgcctaagcaggccaggtccttcccacacctctgctcctggccactgtgctgaattcctaccccccattctccgctacctccttcccctacaccaaaaaaaaaaaagagtgcatccattttggaggctcacttttcttacctagacattttttcaattttttacttcaaaaatttcaaatctatctaaaagttacaagaataggacaatgaatataactttcacttagattaaccagtggttaacattttaccatatttgcttgctccttccttccttttgtttttttttttttttgtgacggagcctaactctgttgcccaggctagagaacagtgagccaagatcgcgccactgcgttccaccctgggtgacagagtgagactccgtctcaaa

SEQ ID NO: 404704 - DNA, 246 bp, Homo sapiens
aataactaaaagctagacactaagtatgagttcctgctaaaagtcaagtgggaaaataaaatagaacaaaagaaccaaccaaacaaaaaaacaacgaagcaataggttatgacattaagttccggagtcaatatgctctggaacttaaacacacacacacacacacacacacacacacacacacacacacacacacactcctcccctctcatgtccccagtccaaccttcctctctgatacgccat

SEQ ID NO: 404705 - DNA, 840 bp, Homo sapiens
cgcaggtcaggcctcacaaggcaccagcggattcatagtggagagaagccctatgaatgcatcgagtgtgggaaaacattttgctggagcacaaacctcattcgacactctatcatccacactggagagaagccgtatgagtgcagtgaatgtggaaaggccttcagtcgcagctcgtccctcactcagcatcaaaggatgcatactgggagaaatcctatcagtgtaacagatgtgggaagaccttttacaagtgggcagacctcagtcaacatccaagaacttttattggggaaaaactttttgaatgtcaccactgaggaaaatcttttgcaagaggaagcatcttacatggcatctgatcgtacataccaaagagaaaccccacaagtgtcttcactgtgagaaaaccttctgttgccaaatgtcatttgtcacctaaggagtcatattagaaaatcacgcagcttagagccttattctccatccgaattcatcctggaaaaacacccagtggttattacgcacttgggaaaacctttagctccatctttctcattagtttacagtgcaatgttatctcaggaatttttataaacagaaagaggtgacatagaaaagaaaatgaaatgcagacactgcttttatactgttgtcttgtatgtacatttctgtcctgtgtcaggaaagttagtaagggaaggtctggaaacttactcaatgtctttgttctacaacattgtctcttcttaagaagcattgtttttatgagaaataatgaagccttgagttatgaaatacttttatatttaaggattaaaagaaacatgaatgcgcaca

SEQ ID NO: 404706 - DNA, 426 bp, Homo sapiens
ccacccagagatggtaccttttacttaggcaagattcacgctttctgtttaaagactttaatcctgggaatcttccggacctctactagctttaaattcgatgccaaaatacgctgtgcgaaggctcaagttccatggaagttcctaaaaacaagaatatttcagcaaaagtaatttttcaatagagcctgagcctggggcttcagagcttactccagagccactgcacttatttcatcacttcctgaagctgggtttttacaactgcacattcctggaaatccaaaactcccaataattgaaaacaagaaaatcccagtcttcacttgtggtgaagcctcaatttccaggttgaaatcttggttggttcatgatgtgacttttaaaacgttactgaattttctgtatctctatttcttcatctat

SEQ ID NO: 404707 - DNA, 649 bp, Homo sapiens
ttcaattctgatttgtcacaatttagattctttttctaagaataagcagaaatttacaaaatttaatttttatttatacattcatccgttcaatacacatttcaagaaagctgtattgcaccctttcagtggtagttacaggacaaagaaacaaaataatccaagagagagaccaacaaatgtatatttataacacagagtaataaacacaaataaatgtggagttatttaagcatgtaagatggtacatgctctaccaggtatgggggcttctctaagacacaagatcagattaaagtcttgaaagataatctggggttagtcaagcaggtagaagtgtgaagagcactttctgagcggaatctccatgtgccaagtctagttcaagagactggatagagattagcaatttggagaatgcaatattaagaaatggcaaaggtgagcctacagagattccaaagttgcatagtgaggtttgtgtttgagaaagtggactcaggcagccacgcaaaagagggattaatagaaaaggagactgaggtagaggtgggaagatctcttgagcccgagagttgaggctgcagtgagctaaggtggcactactgcacgccaggcaaggtgataaagcagggccctgtctcaggca

SEQ ID NO: 404708 - DNA, 4858 bp, Homo sapiens
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctgaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccaggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggcttgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagtagcca

SEQ ID NO: 404709 - DNA, 5507 bp, Homo sapiens
gctctcgaggtgtctggaggctcagcgagcgccggacccaggaggcccaaggagctggaggtgaccctcaggcagcaagaaccccacggaagggcgtgagccctgcagacagctgtgcggcacctcgggctgggctcctgttaggaggaagtgcctgcacccaggcagcggctcagaggcagctgctccatgcagaactgaagctggttctgcagcagaaaggggagaggacacaggagcctggggtgcaggtgcctcccagcaacgccatggaggccaggagccggagtgccgaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctggtacgcgtgcttagcccggccccggccctggactgccccagcgatccggtctctgcgccgtgagccccattccccgccatcgtgggccagccttgccctctgtcttgtcactaacccaagctaattccaccctctgccccttcctctctgccccaaactcttccccgggaagggggacagacccaccccagcccagggccctcacccacctcggagaggcgtccccaccatcggatccaggcttgctaggggtcctgaaccaggctacttcgaaccaggaaagccagattccagcctgagtgctggcccaattactgctgagtggccctggacaaagttgtttctctccctgggcctcagtttccccatctctagaatgaggatgttggggaaaatcccggatcaggatctagaagtcttgggtccccgtccctacactcctgttgactcatttggagatcctagatggctgcctgctttcctgggcactcatggtgaaatgacaggcaagaagtggggatgatgtttggggaacaagatacttgacccagcacatcccccgcctggtccaataccaggtggggctcttcctgtccactcccagcctcccactgtcccaccgcctcctgcctctctcctctctccccagaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaagatgccttcctttgggctggctcgagggaaggaagcagaagttcaaggtgatcgtgccagcccgggggaaaaggctgagtccaccgctgtgcagcttaagatccccgaggtggagctggtcacgctgggcgcccaggaggaagggagggcagagggggctgtggccgtcagtggaatgcagctgtcaggcctgaaggtgtccacagccaggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggcttgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagtagcca

SEQ ID NO: 404710 - DNA, 4793 bp, Homo sapiens
gccgctccagggcctcggagaggccagccggcccgcggagctgtttaaccgttccgcgggtcctagaaagccagctgccctcaggcttgcttaaaggggagacgccggagtgggtgtgccccgacgtcctgcgagggcagcgccgaggggcgtgtgccctgaaggcccgctgaacagccgcttttggccgggcgcggtggctcacgcctgtaatcccagcactttgggaggccgaggcgggaggatcccttgggcccaggaggagttcgagaccagcctgggcagtgtggcgagaccgtcccccacccccgtctctaaatatatataaacatatatatgtatatgagccactgttgagcgcaatggcgggctctgggcgaggtccggccctagagccccaacgcgacacctcgccgccctctgcaggagctgaggcgggcggagttggtggaaattatcgtggagacggaggcgcagaccggggtcagcggcatcaacgtagcgggcggcggcaaagagggaatcttcgttcgggagctgcgcgaggactcacccgccgccaggagcctcagcctgcaggaaggggaccagctgctgagtgcccgagtgttcttcgagaacttcaagtacgaggacgcactacgcctgctgcaatgcgccgagccttacaaagtctccttctgcctgaagcgcactgtgcccaccggggacctggctctgcggcccgggaccgtgtctggctacgagatcaagggcccgcgggccaaggtggccaagctgaacatccagagtctgtcccctgtgaagaagaagaagatggtgcctggggctctgggggtccccgctgacctggcccctgttgacgtcgagttctcctttcccaagttctcccgcctgcgtcggggcctcaaagccgaggctgtcaagggtcctgtcccggctgcccctgcccgccggcgcctccagctgcctcggctgcgtgtacgagaagtggccgaagaggctcaggcagcccggctggccgccgccgctcctccccccaggaaagccaaggtggaggctgaggtggctgcaggagctcgtttcacagcccctcaggtggagctggttgggccgcggctgccaggggcggaggtgggtgtcccccaggtctcagcccccaaggctgccccctcagcagaggcagctggtggctttgccctccacctgccaacccttgggctcggagccccggctccgcctgctgtggaggccccagccgtgggaatccaggtcccccaggtggagctgcctgccttgccctcactgcccactctgcccacacttccctgcctagagacccgggaaggggctgtgtcggtagtggtgcccaccctggatgtggcagcaccgactgtgggggtggacctggccttgccgggtgcagaggtggaggcccggggagaggcacctgaggtggccctgaagatgccccgccttagttttccccgatttggggctcgagcaaaggaagttgctgaggccaaggtagccaaggtcagccctgaggccagggtgaaaggtcccagacttcgaatgcccacctttgggctttccctcttggagccccggcccgctgctcctgaagttgtagagagcaagctgaagctgcccaccatcaagatgccctcccttggcatcggagtgtcagggcccgaggtcaaggtgcccaagggacctgaagtgaagctccccaaggctcctgaggtcaagcttccaaaagtgcccgaggcagcccttccagaggttcgactcccagaggtggagctccccaaggtgtcagagatgaaactcccaaaggtgccagagatggctgtgccggaggtgcggcttccagaggtagagctgcccaaagtgtcagagatgaaactcccaaaggtgccagagatggctgtgccggaggtgcggcttccagaggtacagctgctgaaagtgtcggagatgaaactcccaaaggtgccagagatggctgtgccggaggtgcggcttccagaggtacagctgccgaaagtgtcagagatgaaactcccagaggtgtcagaggtggctgtgccagaggtgcggcttccagaggtgcagctgccgaaagtgccagagatgaaagtccctgagatgaagcttccaaaggtgcctgagatgaaacttcctgagatgaaactccctgaagtgcaactcccgaaggtgcccgagatggccgtgcccgatgtgcacctcccagaagtgcagcttccaaaagtcccagagatgaagctccctgagatgaaactccctgaggtgaaactcccgaaggtgcccgagatggctgtgcccgatgtgcacctcccggaagtgcagctcccgaaagtcccagagatgaaactccctaaaatgcctgagatggctgtgccagaggttcgactccccgaggtgcagctgccaaaagtctcagagatgaaactccccaaggtgcctgaaatggccgtgcccgatgtgcacctcccagaggtgcagctgcccaaagtctgtgaaatgaaagtccctgacatgaagctcccagagataaaactccccaaggtgcctgagatggctgtgcccgatgtgcacctccccgaggtgcagctgccgaaagtgtcagagattcggctgccggaaatgcaagtgccgaaggttcccgacgtgcatcttccgaaggcaccagaggtgaagctgcccagggctccggaggtgcagctaaaggccaccaaggcagaacaggcagaagggatggaatttggcttcaagatgcccaagatgaccatgcccaagctagggagggcagagtccccatcacgtggcaagccaggcgaggcgggtgctgaggtctcagggaagctggtaacacttccctgtctgcagccagaggtggatggtgaggctcatgtgggtgtcccctctctcactctgccttcagtggagctagacctgccaggagcacttggcctgcaggggcaggtcccagccgctaaaatgggcaagggagagcgggtggagggccctgaggtggcagcaggggtcagggaagtgggcttccgagtgccctctgttgaaattgtcaccccacagctgcccgccgtggaaattgaggaagggcggctggagatgatagagacaaaagtcaagccctcttccaagttctccttacctaagtttggactctcggggccaaaggtggctaaggcagaggctgagggggctgggcgagctaccaagctgaaggtatccaaatttgccatctcactccccaaggctcgggtgggggctgaggctgaggccaaaggggctggggaggcaggcctgctgcctgccctcgatctgtccatcccacagctcagcctggatgcccacctgccctcaggcaaggtagaggtggcaggggccgacctcaagttcaaggggcccaggtttgctctccccaagtttggggtcagaggccgggacactgaggcagcagaactagtgccaggggtggctgagttggagggcaagggctggggctgggatgggagggtgaagatgcccaagctgaaggtgtccacagccaggcaggtggtcactgagggccatgacgcggggctgaggatgcctccgctgggcatctccctgccacaggtggagctgaccggctttggggaggcaggtaccccagggcagcaggctcagagtacagtcccttcagcagagggcacagcaggctacagggttcaggtgccccaggtgaccctgtctctgcctggagcccaggttgcaggtggtgagctgctggtgggtgagggtgtctttaagatgcccaccgtgacagtgccccagcttgagctggacgtggggctaagccgagaggcacaggcgggcgaggcggccacaggcgagggtgggctgaggctgaagttgcccacactgggggccagagctagggtggggggcgagggtgctgaggagcagcccccaggggccgagcgtaccttctgcctctcactgcccgacgtggagctctcgccatccgggggcaaccatgccgagtaccaggtggcagagggggagggagaggccggacacaagctcaaggtacggctgccccggtttggcctggtgcgggccaaggagggggccgaggagggtgagaaggccaagagccccaaactcaggcttgccccgagtgggcttcagccaaagtgagatggtcactggggaagggtcccccagccccgaggaggaggaggaggaggaggaagagggcagtggggaaggggcctcgggtcgccggggccgggtccgggtccgcttgccacgtgtaggcctggcggccccttctaaagcctctcgggggcaggagggcgatgcagcccccaagtcccccgtcagagagaagtcacccaagttccgcttccccagggtgtccctaagccccaaggcccggagtgggagtggggaccaggaagagggtggattgcgggtgcggctgcccagcgtggggttttcagagacaggggctccaggcccggccaggatggagggggctcaggctgcggctgtctgaagcccctagtcagatggggatcccttcttgccttcctttctctaccccctcgctgttgtgtgtgtgataactagcactaaccctaagagggccgggaggtgggtgactgaccagggctggcagggaggcctgctcctgtctctctggcaggagtgcctgtaccccaccaagccatgtgaataaaataatctggaagtagcca

SEQ ID NO: 404711 - DNA, 3872 bp, Homo sapiens
ggaggtcttgtttccggaagatgttgcaaggctgtggtgaaggcaggtgcagcctagcctcctgctcaagctacaccctggccctccacgcatgaggccctgcagaactctggagatggtgcctacaagggcagaaaaggacaagtcggcagccgctgtcctgagggcaccagctgtggtgcaggagccaagacctgagggtggaagtgtcctcttagaatggggagtgcccagcaaggtgtacccgctactggtgctatccagaattcccatctctccctgctctctgcctgagctctgggccttagctcctccctgggcttggtagaggacaggtgtgaggccctcatgggatgtaggctgtctgagaggggagtggaaagaggaaggggtgaaggagctgtctgccatttgactatgcaaatggcctttgactcatgggaccctgtcctcctcactgggggcagggtggagtggagggggagctactaggctggtataaaaatcttacttcctctattctctgagccgctgctgcccctgtgggaagggacctcgagtgtgaagcatccttccctgtagctgctgtccagtctgcccgccagaccctctggagaagcccctgccccccagcatgggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggctaga

SEQ ID NO: 404712 - DNA, 3381 bp, Homo sapiens
agggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggctaga

SEQ ID NO: 404713 - DNA, 3445 bp, Homo sapiens
agggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaccgctgctgcccctgtgggaagggacctcgagtgtgaagcatccttccctgtagctgctgtccagtctgcccgccagaccctctggagaagcccctgccccccagcatggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggctaga

SEQ ID NO: 404714 - DNA, 3307 bp, Homo sapiens
atgcccatgaagtggagtgggtggaggtggagctgggggccggccactcacacagccctcccacccccacagggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctgtgccccacttctccatggcagcaccccgtggcaatgtcaccagcctttccttgtcctccaaccgcatccaccacctccatgattctgactttgcccacctgcccagcctgcggcatctcaacctcaagtggaactgcccgccggttggcctcagccccatgcacttcccctgccacatgaccatcgagcccagcaccttcttggctgtgcccaccctggaagagctaaacctgagctacaacaacatcatgactgtgcctgcgctgcccaaatccctcatatccctgtccctcagccataccaacatcctgatgctagactctgccagcctcgccggcctgcatgccctgcgcttcctattcatggacggcaactgttattacaagaacccctgcaggcaggcactggaggtggccccgggtgccctccttggcctgggcaacctcacccacctgtcactcaagtacaacaacctcactgtggtgccccgcaacctgccttccagcctggagtatctgctgttgtcctacaaccgcatcgtcaaactggcgcctgaggacctggccaatctgaccgccctgcgtgtgctcgatgtgggcggaaattgccgccgctgcgaccacgctcccaacccctgcatggagtgccctcgtcacttcccccagctacatcccgataccttcagccacctgagccgtcttgaaggcctggtgttgaaggacagttctctctcctggctgaatgccagttggttccgtgggctgggaaacctccgagtgctggacctgagtgagaacttcctctacaaatgcatcactaaaaccaaggccttccagggcctaacacagctgcgcaagcttaacctgtccttcaattaccaaaagagggtgtcctttgcccacctgtctctggccccttccttcgggagcctggtcgccctgaaggagctggacatgcacggcatcttcttccgctcactcgatgagaccacgctccggccactggcccgcctgcccatgctccagactctgcgtctgcagatgaacttcatcaaccaggcccagctcggcatcttcagggccttccctggcctgcgctacgtggacctgtcggacaaccgcatcagcggagcttcggagctgacagccaccatgggggaggcagatggaggggagaaggtctggctgcagcctggggaccttgctccggccccagtggacactcccagctctgaagacttcaggcccaactgcagcaccctcaacttcaccttggatctgtcacggaacaacctggtgaccgtgcagccggagatgtttgcccagctctcgcacctgcagtgcctgcgcctgagccacaactgcatctcgcaggcagtcaatggctcccagttcctgccgctgaccggtctgcaggtgctagacctgtcccacaataagctggacctctaccacgagcactcattcacggagctaccacgactggaggccctggacctcagctacaacagccagccctttggcatgcagggcgtgggccacaacttcagcttcgtggctcacctgcgcaccctgcgccacctcagcctggcccacaacaacatccacagccaagtgtcccagcagctctgcagtacgtcgctgcgggccctggacttcagcggcaatgcactgggccatatgtgggccgagggagacctctatctgcacttcttccaaggcctgagcggtttgatctggctggacttgtcccagaaccgcctgcacaccctcctgccccaaaccctgcgcaacctccccaagagcctacaggtgctgcgtctccgtgacaattacctggccttctttaagtggtggagcctccacttcctgcccaaactggaagtcctcgacctggcaggaaaccagctgaaggccctgaccaatggcagcctgcctgctggcacccggctccggaggctggatgtcagctgcaacagcatcagcttcgtggcccccggcttcttttccaaggccaaggagctgcgagagctcaaccttagcgccaacgccctcaagacagtggaccactcctggtttgggcccctggcgagtgccctgcaaatactagatgtaagcgccaaccctctgcactgcgcctgtggggcggcctttatggacttcctgctggaggtgcaggctgccgtgcccggtctgcccagccgggtgaagtgtggcagtccgggccagctccagggcctcagcatctttgcacaggacctgcgcctctgcctggatgaggccctctcctgggactgtttcgccctctcgctgctggctgtggctctgggcctgggtgtgcccatgctgcatcacctctgtggctgggacctctggtactgcttccacctgtgcctggcctggcttccctggcgggggcggcaaagtgggcgagatgaggatgccctgccctacgatgccttcgtggtcttcgacaaaacgcagagcgcagtggcagactgggtgtacaacgagcttcgggggcagctggaggagtgccgtgggcgctgggcactccgcctgtgcctggaggaacgcgactggctgcctggcaaaaccctctttgagaacctgtgggcctcggtctatggcagccgcaagacgctgtttgtgctggcccacacggaccgggtcagtggtctcttgcgcgccagcttcctgctggcccagcagcgcctgctggaggaccgcaaggacgtcgtggtgctggtgatcctgagccctgacggccgccgctcccgctacgtgcggctgcgccagcgcctctgccgccagagtgtcctcctctggccccaccagcccagtggtcagcgcagcttctgggcccagctgggcatggccctgaccagggacaaccaccacttctataaccggaacttctgccagggacccacggccgaatagccgtgagccggaatcctgcacggtgccacctccacactcacctcacctctgcctgcctggtctgaccctcccctgctcgcctccctcaccccacacctgacacagagcaggcactcaataaatgctaccgaaggctaga

SEQ ID NO: 404715 - DNA, 1073 bp, Homo sapiens
  misc_feature (861)..(861): n is a, c, g, or t
agggcgacccccttgagtctgtagtgttcatctactccatgccggggtacaagtgcagcatcaaggagcgaatgctctactccagctgcaagagccgcctcctcgactccgtggagcaggacttccatctggagatcgccaagaaaggtttctgccgcagcgccctgcacccgctgtctctcctggtgcaggccatcatgctggccatgaccctggccctgggtaccttgcctgccttcctaccctgtgagctccagccccacggcctggtgaactgcaactggctgttcctgaagtctaaagaaaaatctgcagatgcctccaaggagtccgaaaccaagtccgaagtcaacgacaagcaatgatggcgatggcgatcctagttaataaaaaggggggagatgtgggctgcaagccacccaggtgccgaggcaagagaccgaggacatgagctgttccagtataataaaatctaaaacaagaatagttataccagatatagatcttagatatgattatatatgaatataattaatcattagtttgtggcaattactctttattccaatattataataatcctcgctctataatcataacctaggaaaaaccaggccatacagagataggagctgaggggacatagtgaggagtgaccagaagacaagagtgcgagccttctgttatgcccagacagggccaccagaagggctccttggtctagcggtgacgccagtgtctgggaagatgcccgttgccaggcggaccgaggtctagcggtagcgtaagtgtcaagggaaaacacctgctacttagcagaccgggaaagggaggctcccttttcccgggggagtttagaanagactctgctcctccacctcttgtggagggcctgacatcagcagggtccgcacaagtatccggaagctaaacgcttccttggagcgtgggctaaaaggcaccctcctaaccggcttatattccaatctggtacctgctcttggctttaatagcggggcaattagtgaagtctcaaagcttggttgcctaataacgggtagctggtttttttt

SEQ ID NO: 404716 - DNA, 383 bp, Homo sapiens
ttttttttactgtaagccactatctccccaccaaaagaaaagaaaagaaaagaaaagaaaagaaacccttcatactgtcaatgatttaaaaactaactcttggcaaggtgcagtgggttacatctgtaatcctggcactttgggaggttaaagcaggaggatctctgaggccaagagtttgagaccagcctgggcaacatagtcaccaagaagtgacctcttctttctgtccactgtgatcaggacaggttttctttatgtcacctatgatgttttacactgccttgttttatattcatgtctgtctctctttctatactggtctcctccagggcagaatctgaatctagtttaactctaagatgtctcaagtgaaagtgatt

SEQ ID NO: 404717 - DNA, 521 bp, Homo sapiens
caatgatatccaccttttttcaatattttgcctaaggccaccctggccctgccattcaaaatcaccttttctgtcattttggcgtttgtggtacattgcagaaccctgacttaggccaggaggccatttaggaaattattcctgacattttgttttaaattaataaaatacataaaatagggttccttgtaatagatctcacacatcaagcataagtagatcgcattatttatttttaaatgacatatgctgtagctcagttttgtagaattcaagaatatacttcatcttttgtgtaggtaatttcattcaatttcccagtcccctctttcattttggagaaataaaatttgtgttttatgtctatatatactctccaatggggcaattcaaaaataaaagtgcatccttaacactgcatttctttgcttttggcctgcactagaacttttccctcatttcaatgtagcttttgtatgggtgaatgcaataaaaaaggtaataaacttaataaatggttc

SEQ ID NO: 404718 - DNA, 488 bp, Homo sapiens
aggtggcgggaaaatgtaaaactttaaagctcatgagcggaacgcaatgcaagtcctgaaactaagagttaaatgtgagtctcagggaaaaaagctagattagcaaatcaaacatacatatgcctcatccagaacatcattcaggcatcagttcgggggctactagcagtaaagttggttttaaatgaaataaagtggaaaagtttgatatcacttccagaagtggtctgtcatcagtaagtattggtgttgagtctaaaatgaattagaaacctcccgttactcttaggattaaagcaacccggtatggagagaaatgaaagaaaaaatgtagtgttagcttgactttatgtccctttcactgaattccatatgagcctatttggcagagaaattttgtactctacaaggaaaacatcactgatgtggacagcaccaataatgtacgtcccattaagctaataaatacccagacggccgtgtgaata

SEQ ID NO: 404719 - DNA, 391 bp, Homo sapiens
ctggaccaactctccaacagagtttatcaaaatatgaagagctgcctgtgggccttgcggcacttctctaagtcaatattacacattataattctctaccaaatcttaaaatggtttcagagcttgtactgttatctggaaataagagctaggcttcaaagagatactttggtgactgcaggtctccggtagtcctaggaggaaggctaatgactctcaggcaggcatctcaagctcataaatcagtggcttgaagtgaagccatttagaatagaaaccaattaaccacaaatatcaaaaagagataaagcattcataagaaagaggattgccagctgtgcacagccatgttttcatttagctgcagtccagagtcaaactgcccttaagc

SEQ ID NO: 404720 - DNA, 380 bp, Homo sapiens
agtgtcctagagtcacgaatggcaagtgtccaggtcacacatggcacctccctcttcccttactacctccatagcacacagccactctgctcaaagttggcacgagttggaatgtaatcaccatctctgcactcaaggcatgcagaaatgaagtctacctcagccctcaaagacctcacctgagaaaaagacaaggctccaaacagaaggcaaaacagaatgagcatagaaagagaccactttttcacatacctttacaaagcactgctcacccctccttaacctcgcacagacagagcatggggcctcagtgtcactgccactgccaccctcccactgactagctgtactctctgaatttctggggctcagcttgacac

SEQ ID NO: 404721 - DNA, 786 bp, Homo sapiens
aaaagaatgaatgactataattttggcaattgcagacctattcagtgtcatttgattgaatgattgatcaggtggtagaagaggcttgagcaggccgacttgcccttcaggaatactgcctggccttcagattcaaccttattgcttgacactacttggcctgctcagtggcgctatctcggctcaccacaacatctgcctcctgggttcaagcgattctcctgcctcagcctcctgagtatctgggattacaggaaccgggcaaatctaactcagtcttcctttgatccacactggatgagtgaactgcatagatggggttttgctatgctgcccatggctggtcttgaacccgtgagctcaagtgatccatcatgtgcaccactgccccaggtgaactttttacataaagtataagaaaacagattcctcctctcaatgcctacaggaatcccctctgatcttctaactggtaaagtactaagttaaaaaaacctcttagccctctgtctctccaagttgggtagtattaaatatatgaatccatttttagcctgggcagcatggtgagactctgtctccatacacacacacacacactacacacacacgcacacacacacacgaagctggatgtggtggcacatgcctatagtcctagctactcaggaggctgaggctggaggattgcttgagtccaggagtttaaggttacagtgagctatgattgtgccactgcactccagcctgggaaacgcagcaagaccctgtttgttaaacacacac

SEQ ID NO: 404722 - DNA, 822 bp, Homo sapiens
aaaagaatgaatgactataattttggcaattgcagacctattcagtgtcatttgattgaatgattgatcaggtggtagaagaggcttgagcaggccgacttgcccttcaggaatactgcctggccttcagattcaaccttattgcttgacactacttggcctgctcagtggcgctatctcggctcaccacaacatctgcctcctgggttcaagcgattctcctgcctcagcctcctgagtatctgggattacaggaatggggatctcactatgttgctaggactggtcttgaactcctggacttaagcaatcctcctatctcggcctcccaaagtgctgggattacagagatggggttttgctatgctgcccatggctggtcttgaacccgtgagctcaagtgatccatcatgtgcaccactgccccaggtgaactttttacataaagtataagaaaacagattcctcctctcaatgcctacaggaatcccctctgatcttctaactggtaaagtactaagttaaaaaaacctcttagccctctgtctctccaagttgggtagtattaaatatatgaatccatttttagcctgggcagcatggtgagactctgtctccatacacacacacacacactacacacacacgcacacacacacacgaagctggatgtggtggcacatgcctatagtcctagctactcaggaggctgaggctggaggattgcttgagtccaggagtttaaggttacagtgagctatgattgtgccactgcactccagcctgggaaacgcagcaagaccctgtttgttaaacacacac

SEQ ID NO: 404723 - DNA, 149 bp, Homo sapiens
gatccacactggatgagtgaactgcatgtgggtgtcagaactcagtgcttttgtactgaggctgtcaccttgttacctgagggctgccttaaatcctcaacctaatctcagctgttgcctctggcattccctggttattagtttcttgt

SEQ ID NO: 404724 - DNA, 363 bp, Homo sapiens
atggccagagattgatagaaaagaaaaatataaattacatacctggcttaacagttcttacaaagagtatattagtatgctagtgccacaatactttaaacttttttcctagaacaatgttttcctacttcctgatgaaaaagactcccataaaactctttgataaccaccatcctctcctccagcattgctgctcaactgaaatcccactaataaaacaacttgtgtcattctttaagggcaagactcaaaagactatttcttgggaggtatatttattgccttcaattcatgtggaagtataaaggactgatagatcctttttttttttttaacaaagtacatttaacaggaaaagagata

SEQ ID NO: 404725 - DNA, 769 bp, Homo sapiens
tcaactacttagcacaacaattcaatgcaataagtacaaccagactcattttcaaggtaagaaatcctaaggtaaaagaaaggagaacatagacaaatatcagaaagatataaaatggcccaatcagaagtcccaaaacagttgaagaggaccccaaattctagtcttcaatctggaataactgagtgccttggcaaaccaccccacttccccagatcttagattccctacgtgttcaataagtgacttgaaccagagagctctgaaggttgcttccagcctttacgaacaaataaatacatctagattttctattctaggacttagccccatcaaaaaacatcacaagccagatcaggataagacaagaaaagaaaaaaaaaaagcttaaaataagaccattccagaaaaactttatatcaagtttactcttttacacagaaaaggagaatggtaattattcaatcagaaaaaaagaaatgatgattattcgaataagataccactgaaaactccaacaaggagagaaggatttttgcttcaagtattttgtgattactgacaatagttatgttctctggtctctgtaatgagaggcatctgcagcactgtttgtgcccttggagggcagaaaggtggcactgccaaggggctgtcactctactcctcctttgtctttgtatccacctcctaaggaacaaagacacagtcattgccctcaggccctcagttaccttcactttttcccaggattaggtaacacctgcag

SEQ ID NO: 404726 - DNA, 567 bp, Homo sapiens
gcaaggagtgcaattttttgtgcttttcccatcaattctgataggtccttttgtttcccttgagcaacagaggccattgatcctgccccgttgaggtcagtttcctctctttctgagcctgtccgaaagtcaggggtcaagctcagccttgtttgacccactgacctttctgagggggccaccttttgtaagcaaagtcaggctttgactaccttaactgggatcccctcttacgaatggcaaagttattttgcggtgtttgctttgggtataaggaaagaacttttctcttcctctcttttcctcttgtggtttacttttggattacttaaataaatagcttgaaaatgtcccgttaagcatccaaagagtgctaatgcagcacaccatgtttatttatatgctttccaccctgtgtactcccttcacctcacagtttaaggcaaagtaatgcatttctttttcctaatttctttcacttctggaaagaatttttgccaggagcaaaaggagctgccttcaaattttggtcagatggtgaagatgcttaaatgatcatctttgttg

SEQ ID NO: 404727 - DNA, 228 bp, Homo sapiens
aatatttgaccttccagcctcttagcatcagctggtacttccttcttttctcttcctgagccatgagtcatgcttcatcaaaagtttcccaggctcctgaagtgaaaatgacaaatcagtgcataagagtgataggaagagaagtacaagattgtattagacagtatagaacaaaacactttgcagaatgaaaaattgcagagtgctgacacttgttctacagaaagg

SEQ ID NO: 404728 - DNA, 505 bp, Homo sapiens
gcatttcttaaagaagcacggtgcggggtggaacccaggagagtgactttggttcccagctgtgtccctgagtcattatttggccttggcaagtcccttcccttctttgttttcccatctccagtgtcttgtggtcttaagtccttgggttagaattaactcaacagctcatagcatgctttcgcctccattcgtcctcactaaatagactgggggagctgaggacgcaggcactctgctagaggccaggcctctcttccaggcctccagctggtatgcaccttccttcaggtaccccagagcttgggtcatggcccaagtatttcccagagaggaggaagagtatgttttaaccttcccttccaaccttttttggcgctgtgcatggtggcacgtggctgtaatcccagctactcaggaggccgaggcgggaggattgcttgagctcagagttgttcaagtccagcttgggcaacatagcaagaccctgtctgtaaaaaaaaaa

SEQ ID NO: 404729 - DNA, 507 bp, Homo sapiens
ccaaagtaggaccgtttctccaggttcatggctcgcactgggcaaaattgagacccataatgtagtttggaatgagacctctagaaacctgaatttccgcaaatctgaggaatctcttgaactgcagaagtgagctactccttcttatcatgagctagcatttcttcttgcgtgaagaaaatgcacaggtttctctctcaagtcaacatatcatcccctcaggatgtacctcccaaacatccccttgccataggccataactagggttaaatcacagtaagagaagaaagtacagaagtaggcgcacagatagaaatggagatgacaagaccctgaaactatagaaggcaggtgtcagcatttgactgtcagcagccaggtggattgaattactgtaatgagccccaaggaaacctgacaacagagagctatggaaatcgttaacagaatgtgttgccaccttactcctgagtaaaacagagtacttctcaacatgtgccatcagaa

SEQ ID NO: 404730 - DNA, 323 bp, Homo sapiens
ttgagtcacaaggtggcagagtcagaacctactagtctagggatgtcagtttacagctcagtacccaaggtccatgaaagcccagtgaggagcctgaagttgcacagctaaaggaagggctgggactcgaactcatggctctgtggttcagtcctttggctaaagggtccatgaacgccacccacaaagaatgtattgaatgttttgcttctgggctctggaggcatccagggtagctggggggttccctgccagtgaggagggagcaggcactggcacaccattcctcagtagcccgacctcattcaatctggcaggtaggt

SEQ ID NO: 404731 - DNA, 724 bp, Homo sapiens
atgctgtgtatttacttgaactcatacatcagaagatagtgatcttaacacgtatttcaattcttatattgtgtgctggtgataagcaaaagttgtggcttttttcttaagagggaattgtttagaattctgcagcctatataaatattatgtttgggaagtttaaaatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggtagagtctcactttgtcacccaggctggagtgcagtggtgtgatcctggctcactgcaacctctacctcccagatatctcttccaaatgcatgatgaaggaggtcttgtcaacagggcaaggcaatacagaagtgatccacacagggacattgcaaagacatgaaagtcatcacattggagatttttgcttccaggaaattgagaaagaaattcatgacattgagtttcagtgtcaagaagatga

SEQ ID NO: 404732 - DNA, 657 bp, Homo sapiens
agcggggaagcggatcgggtggagtgtaggtcatatcgccgcgttgactagataacgaaggacaatgcatatatacaaaattgctgtattgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttggagaggtgaggggctgtcctctggatggcaattgatgaaggatgagtctgtgccctgaaggggagatcagtccagcccagctccccactgctgcctcgtgtgtggtggcttctccaggagagaggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggctgaagtgcaatggcacaatctgagttcaccgcaacctccacctcccggattcaaatggttctcctgcctcagcctccc

SEQ ID NO: 404733 - DNA, 391 bp, Homo sapiens
agcggggaagcggatcgggtggagtgtaggtcatatcgccgcggattgattcctaaagactcatgttacgtgaggaagcagctcagaagaggaaaggaaaggagccaggcatggctcttcctcagggacgcttgactttccgggatgtggctatagaattctcattggcagagtggaaatgcctgaacccttcacagagggctttgtacagggaagtgatgttggagaactacaggaacctggaggctgtgggcagagtgagtctccatctcaaacaaacaaaaaataacaaaaaaagacctcaaaaatgcttttcttctcgtataatggacttccttctttttctttctggttcctcttcatttctctctttattttttatttatttatt

SEQ ID NO: 404734 - DNA, 427 bp, Homo sapiens
aagtaaattttgtttaaaaaatccacgtgaattaaaggaaaggaaatgaagaagaagatcgtatcaatacgatgatctaaatcagtgttctgcaacttttctacccagtcatcagtgggagtgaatcagtaggaatgtggggaagggagtgaggggagacccccttcttgactcagcagtggtgacggtcggtgtgtcctgcagacctgaagccaagatcaagggcgcttgagcaccaggagcccccgcagttcctgaatgaccagcggagggcaggtgccagcctgtggcaaaataggaaagaaaaggacaggatggggacttcaccatttttttcagccttaaattgttccttaaaccttcatgtccttttctctaatgtatgttcttgtttggtaaaataaaaaagtttgtaaccctgaaatct

SEQ ID NO: 404735 - DNA, 476 bp, Homo sapiens
tgcctgcctccggcccctctggagccctgggttatgtgaaagcagccgtgccaagctggcccatgggcggggctgagtcttcctggctggcttgtgacatgttcttgacgtactgtgtggtcaacgaagctggaactgggggggctgaacaagggccaagccttgcacttcagcttcctgacctggcagccattcagagagaccctgctaagtgctatttcctaaatacactctcttttcataacaatcttaccacattgctttcctttacaagcgctcttaaaacaagagaactggactccttctggttaatctacacagactacatttggaaaccatcagaaactgaactctaaacaaaacgttattaatgtgttgtaatctgccctctatgttgcagatgaaaagaaaatgttttatagttttggagcatacgttttaattgccttttaagagtgcatatacttttagtactt

SEQ ID NO: 404736 - DNA, 684 bp, Homo sapiens
tggttccccagaaataataggtcccccccaggggcaggggctgacaatacggctgccttacccgccatacataaagttttatttttttggcccgaatgagggagcctcccgaaggattaaacgacgccccgatcctcaccggacctcaactaaccctaaaaaatgcacacctcaggagtctacctgagcattcaggcagcactgacaatagttatgcctgtactaaggagcatgattttaagaggctttggcccaactgcctcttgcaggctgagtccctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagaggctttggggtcctagcccagtgcttctccaacactgaagtgcttgcagatcatctggggacctggtttgaatggagattatgattcagtgggttgggggcagagtttctgcagttccatcaggtcccccccaggtgcaggtgctgacaatactgctgcctta

SEQ ID NO: 404737 - DNA, 176 bp, Homo sapiens
cttcatctgtcacattttgacgctctctgcgttgaagacttcccaatggactcattaaatttcccattcaaagctcttcatttatcactatcatggtagcaagccaaccaaagagagacccattcactttgtctctgatcttccgagtgtaccagcaaagattccggctttgaatt

SEQ ID NO: 404738 - DNA, 405 bp, Homo sapiens
gagcacaaaatgaagttggtgattcatgggcagcagccacttgaaaatatgaacactcctgcgtccccagccccgccggcctttcacacccatttggaggcgtgttgagcagagctgctagcctgctgcatcctagtctgcatgtgtttgggcaggatgtgaggacaggccggttctaccctgacaaggagcctgcaaagggcagcagcacacctgggagcactccaagaacgtctgcccaccccccgagaggcctcggctggaacccagggcagggctgagtaagaggtaagccccgagaggacctgcggtcacagagaaaggacacttcctgctcctgccctctgtctccaggggcgacgctggcaacagagcagctttctgatgacgcttgttctgctgaac

SEQ ID NO: 404739 - DNA, 570 bp, Homo sapiens
gagcacaaaatgaagttggtgattcatgggcagcagccacttgaaaatatgaacactcctgcgtccccagccccgccggcctttcacacccatttggaggcgtgttgagcagagctgctagcctgctgcatcctagtctgcatgtgtttgggcaggatgtgaggacaggccggttctaccctgacaaggagcctgcaaagggcagcagcacacctgggagcactccaagaacgtctgcccaccccccgagaggcctcggctggaacccagggcagggctgagtaagaggtgaagtggcacagtaacgcattccaggaggacatcgctgagggccccaattgtgaggacattgcccatcaatcttggagcctccacaccaagctgggattctctctcttctggacttcatagccttctgagaccgcactggggatgtctggctgagtctaaattgaattattaatctactcctgtgtgcccgtgtcattttccagacaaccagtttattcatgactcgcccactatcaatttcaacatgcaatttgcaatgaaatttgactgatcagcaat

SEQ ID NO: 404740 - DNA, 963 bp, Homo sapiens
gagcacaaaatgaagttggtgattcatgggcagcagccacttgaaaatatgaacactcctgcgtccccagccccgccggcctttcacacccatttggaggcgtgttgagcagagctgctagcctgctgcatcctagtctgcatgtgtttgggcaggatgtgaggacaggccggttctaccctgacaaggagcctgcaaagggcagcagcacacctgggagcactccaagaacgtctgcccaccccccgagaggcctcggctggaacccagggcagggctgagtaagaggtgaagtggcacagtaacgcattccaggaggacatcgctgagggccccaattgtgaggacattgcccatcaatcttggagcctccacaccaagctgggattctctctcttctggacttcatagccttctgagaccgcactggggactgggctcactcttctgaagccatagctgacctaagcgacccacctgggcttttaaggtgggctacattcccccaggcccaggaactacaaatgggaggccaggagtgctatatgccgcagccagaggcgtctgtgctccaaaaagtcttctgagtgggcttctcagcagtggatgggaacgtagggcagtcttctcctccccacaccactcaaaactgcaattttacaaaccaagaattaaagcctggaatactcagtgtcctgtggtctcccaaagtgggaggatcctaaagcaggacgggcttcccttagaagccaggcatattggcaggaggtacccaggtaaacaagcaaccttggggcaatgttaatctgctttttctcttcttcggtgtctggctgagtctaaattgaattattaatctactcctgtgtgcccgtgtcattttccagacaaccagtttattcatgactcgcccactatcaatttcaacatgcaatttgcaatgaaatttgactgatcagcaat

SEQ ID NO: 404741 - DNA, 519 bp, Homo sapiens
cccttaaagccttcagctttagaatgaaagactcaaactcttctctgggatcttaatttttatgtggcttcttattacttttttatcccttctaaaactctaaatcccttcaacatagctttggccccttccacagctgaactggcagcaggctgatctttttattggtgggtaatggatttagtttgattgctgacacgggaacaatgagaggataaacaattccatttgtggccatgaaatttcccatctgttgagtgcgttcaggactgcagagcactgggcagagacagatgaatgagcccgccacgcctgatgttaaggacatccgtcatacaagctgaacatgtggcttcataaatcaacagctaatagcaactctggttgctcctgtcattaacaagccatccgtttaaatacataagagtttgccataacattcagcctagagacctgacttgcaattctgatctcaccaaaaaaccagaagtagtaaagaaagccaaaaaagcataagta

SEQ ID NO: 404742 - DNA, 535 bp, Homo sapiens
ctagtcatcgaagttatgactatctagggttttgtttccttttattcctttaactctgtatttctttctatcagtgaagtttgtttttaaaggtacctggggcagggaagcagggtggagatagagcccctccttgcctggagcctacagtaaggagccaggttcaggaggagtggattccttggttgacttggccatgcagaaatagtcttagactcccccaggatttaaaataggattgaaacaagaagtttaaaagagcagaggaggaatagagatacttagtgccaataaaaatatcatggagacttcttcggctttttaaaaaaaatgcttaatccattattaaaataatgattgactttattttatagtaatatgtgataatatgaagttaggatgacttgccatttcagatttaaaatacatattaattaagtgactactatgttgtgattttgaataatgtttaagtttctatattgattgtatgcctggtataataaaggaaaagactgccttattgtccccttta

SEQ ID NO: 404743 - DNA, 731 bp, Homo sapiens
acaagcacccccgaggggttctgatggaagtactggctgctcacaaatccacccttcctccaggtaccctgccaccccaaccccactggagtcaccaggtctaaggcacatgggagagtttgcctctcacccctcctcctttcatactcactctgccccctgctctggtccaggccctgttctcttagctccctggtctcccccagtccatgacttataacactgccaagaattttctctctaaaatatcaatgtgatgatgccctggctcctaagccgccaggattccagactgccttcaggcaaagtctctatctcttgagcggaatgcagaacttttcctgctcttgcccctaaatcaccagtccagcctcccctcccattctctagccccttcccccaggcagctgtccgagggtctccctagcccccaatccactggaccttctcggtgaatgcgtccgacggacgcatacagactggtccacgtgggcttgttagcaggcagaggaaccctgctttccaaaaactgatatagtccagagtcacggcatgtgggaatgtttccatggacactggatcttaacagatgctatagtgtttacaaaactacacacacagagaaagcccaaggaagcctgcaggctaagcccctatgcttttagagggctgaaggaaccaaacctagtttactcctgtgtgtttgccccatgcaaaacttatgggagact

SEQ ID NO: 404744 - DNA, 443 bp, Homo sapiens
aaacattagcacttaacctcagtcaggattttgtctgtgaaacaggaaaaatagaagagaagtcagatttgatctgcattctgaaaatgagaatttttttatatttaaactcctcttattttgtattccttaatgttcttattaatcattcatatcaaatggcttgtctttctttcagagccttgaacattttaaagacaccatgtcattctttttacaagagagagaaaaaattacgcagttgaaagagttcccaagggagctattgtgctacacgctggcaaaagttttattagctaaacttctgactgaaaggaaaaataaattcaggtttaggaacggcttctatttattgtaaggaagtttacaaaaattactgaaaaatatcccaagaacacaatgtaaatttactctggtggtattttttccatccttgcttctcc

SEQ ID NO: 404745 - DNA, 422 bp, Homo sapiens
ctctgtcccccaccaagaaattgatttctgccctgactggcttgggtaggcattctaggtcatccactgtctgaggtcaatttggaactgatgaagaattcttagagtgaggtgacaggataaaacaccaaagagattcagaaagcctgggttctgatcccattttggccaccgtcctctcaattctttcaacaaggatttattgaacatgacaggcatgctccctgccctcacaaaacttggagtctagcaccaatttgctgggtagaattgagagagtcattttgcctacttcattcagacacctacacacatatacacactcaacttccctctatcatgccatgtccccttttaccatctagactttggacacgctgttctgtctagaatacgctttccttattgtatatagctaatgc

SEQ ID NO: 404746 - DNA, 707 bp, Homo sapiens
aaatcatgattttgcatccattaatgaaataatggatctgggcagaaagcattgatggctggggaaaattagatggagaactttataatggagaaatcaggctgatgctactcacacttcagtcaatctgatcactaaaagtgggataatgaatcagtgataaaatgacatttttgagacaattggggattttgaatatggactaagtgttagataaaatgatgaagtgatatcttaaaaacattcagccaaaagaaaaatttggaaaaagatgtgaaaacagcttgactctttggggttaatgttgaagggagatgattacatagcaattcattgtaccagtctttctacttttctatatatttttaaatctcaaaaaaaaaatcttaaatgtaaggtcatagaaaggaagaaataacaagaaaagtttgaagaatcaatagataaagaagatgaaaaccaagaatggtatcaaacaaactaatcaggaaagaatataaggaggagcattcagcagtatgaaatccagcagaaaaattcaggaaaaaaaaacaatttggggggtgaaagactgagaacagtgaaaaaagattgctgacagcaaaaagaggctattaattgagagagtgacctttgagatgttgtagaagggggtcaacaaactatgatccatgaggtcaaagctgctgtcatctgtttttgtaaat

SEQ ID NO: 404747 - DNA, 700 bp, Homo sapiens
actctgccacaaccactctctagaacctggaattctggaaggtactagctcactactaacatattggaatgtagtaagttcctttccccttttctccctcccttacatttcaaagcacttttttttcgaatcctcctgctactggcaaaatgtggtgcaggagttccattaagagacagctgcaggccgggcatgatggctcatgcctataatcccaacacattgggaggcagaagcgggtggatgacttgagctcaggagttggagaccagcttgggcaacatggcgagaccacacctctactaaaaatataaaaattagccaggcctggtagcatacatctatatagtcccagctactcgggaggctgaggtggggaggatcgcttgagcctgggaggcggagagtgcagtgagctgagattgcaccaatgctccagcctgggtgacagagcaagattctgtctcaaaaaaataaataaataggccaggcgcagtggctcatgcctgtaatcccagtactttggggggccgaggcgggcagatcacctgaggtcaggagttcgagaccagcctgaccaacatggataaaccccatcttactcgggaggctgaggcaggagaatcgcttgaacccgggaggtggaggttgcagtgagccgagatcgtgccattgcactccagcctaggcaacaagagtg

SEQ ID NO: 404748 - DNA, 644 bp, Homo sapiens
accaggtggggtctgtgcccacatcgcacactctgaccccaggccctggcattagctgtatgtcaccttgtcactcaggcccttgctcgaagccccaaagtaggagtccaacgctgacctgagaatcagcacgcggctgccccctgctggttaccaacagagttcccaccgtgaggataaggcagtggctcagagccagggtgacccactcacagccacatagccatggggagacacctggtctttctgtacccaccagacagggccaccgggtcgaatcttgccttcctcagacaggtttaatcccaaacacaggcttccacgatgccgtcaaccatttagtcggccaacatgccccccaggacggcagggaccctggcatcagcagggcatgaggagaggcagccgatggacctctcaccctgggaagacacaaacgtgagccatcacagccaccatgaagatgactgggccttgtgctgacctcccagagagcagatgagggcggccaagggccacttacgcacagatggaaaaaccctgtcccccacatggcccaacattcagtttggtttaataaatcctcacagaggccgggcggggtggctcaagtctgtaatctcggcactttgggaggccgaggt

SEQ ID NO: 404749 - DNA, 628 bp, Homo sapiens
tgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatggga

SEQ ID NO: 404750 - DNA, 436 bp, Homo sapiens
aaagcagagtttattgctatttgccatgctgctagtcgttatactatcgtggtgctttaaaaagaagaatactgacctgtggtctttccttaacatagatagcaaaaatatctaaaaacaaaaaaaaaaaaccaaaacctcgtgccgaattcgacacgaggcctcgtgccggcaaaagcagtgcttatagagaaatttatagaactaagtgcacacattaggtaaaaaatatataaagaaaattacttgtgattctacttttaagaaactacagaaagaagagcaaattaggcctaaaccaagcaaaagaaaagaaataattaaaatgaaagcagaaatcattgaaattaaaaacaggaaaacagtagagaaaagtcaataaaaccaatgttggttctttgaaatcatcaaccaaattgataaacctttaaccaag

SEQ ID NO: 404751 - DNA, 693 bp, Homo sapiens
ttccagaagtttttaggctgacactcatggctttcaatacatgcaataatagtctgttgcccatcgatagtttttagcataaacagtacagaagccgttggaataatggtctttcacataggctcttaaagcactgtcacaggattctctccaagacttcagacctccatctacttgttttggctgggggtcacttgcttttttctataagtgatcaaatgtaaaggaaattttgtttcttggatctaaaactctgctattacccaggtcccccatgctctgtaattatgacctgatcttcacatccttccatcttcacgggtgtgaactgatccatgttataatgggcaaatgcacgtgctgccctttccctgaggagactgtcattattacatagtagccgaatatcactgaatacttcattaaattctcctgcgggtgcatgagtgatgaatttagcagctatgcataccttctccttatccaacacacaatcattgaagttggccatcttgggctgttctcaacatttatattttgacacttaaaaaagacgattccttaacgtgtctattgttaatcgttctgcaatgaacatgggagtgcagacatctcttagacaaactgtttacaagtcctttgggtaaatcccacaaacaggatggctggattatatggtaattctatttttag

SEQ ID NO: 404752 - DNA, 513 bp, Homo sapiens
attaatatactgtgatttatttcaaaaataataagggatgggaacagggatgggatatagatggaataggattgaccactgttgaaactgggtgatgggattctgtatacttttgtatatgttagaaaatttccataattaaaagttgaaaagaataagtaaaaagaaattcaagaatgattccaatttctgtgtcatttagatttgaaacatcaataatcttttgtggagaagaaaagtcctctgatttttcaggagaaaaaaaagttgggagaaagagtttacaagtacaacagcacagtaaaagaactgaggtaaataaagatttggaaatttttcttttaccttcaaatattttccttagccctcaaacattcccttaaattttttagtccaagtgttgaaatgtcacagtcttaaatatcactacctggtcttgcttctcctcttctgttcttaattctcctttttcttctccttaaaaaaaaaatagaacaaggaatcttttcagga

SEQ ID NO: 404753 - DNA, 274 bp, Homo sapiens
ccgctcggtacccactttcagagtagctgggactacagatttgaaacatcaataatcttttgtggagaagaaaagtcctctgatttttcaggagaaaaaaaagttgggagaaagagtttacaagtacaacagcacagtaaaagaactgagattatccctccttttctgaagctgtcaaaggagaaggtgacaaggaaagaaaactctttatgcaagttgccgaatcagtacagcgttcacaagacttcatcacctctttgtacatcttctgcaa

SEQ ID NO: 404754 - DNA, 492 bp, Homo sapiens
aacctgattctgattcagttgaatgcaccaagatgatatgcagtctgaataaaccattaggtatcaatttagtcacgtttgtgatcaaattgaattaatgatttaaaaaaacagccgttctcaaagtgtggtttttttggatccttcaaggacctcaagactctctcacgattgaggtctttagatttcacttaaactaatcatcatgaaactatcagccgggccgtgactgatgcctgtaatcccagcactttgggaggcggaggccggcggatcacttgagcccagcccaggcgttcaagaccagcctgtgaaacacggcaaaacttcatctctacaaaacatacaaaaattagccaggcatggtgtctcatgcctgtaatctcagctactcgtgagactaaggtgggaggatcacttgagcccaggagctacagtgaggcactgcaccactctactccagcctgggtgacacagcgagacactgtcttt

SEQ ID NO: 404755 - DNA, 214 bp, Homo sapiens
ttataaaaatttttactattacatatgttgaaaatattttttctagtttgtgccttgttttttatctttggccataagatctttgaaaataccaaagtataaaaattagccaaatctgtcaaatgttttctttatggatttcagattgcaatttatttaaaaaggctttttaatttcaagactattaaaatatttcaattttttctctaatgtg

SEQ ID NO: 404756 - DNA, 504 bp, Homo sapiens
taaactataaaatagatgagatgagctgctgttgatgtgaaaaatattaagtgttggctgagatttaggaacatctaaatctaaacgactttcgtgacattcttggacattgggattgaggaggtgtctcacctgggagctctctttgcactatgatcaaaatggagtcttgccagctgcccagggtaatagccttgaacgtctcttccttggtgagcgatgaatatactagagcagaaagtgaggaggtgagaagaaagccattcttacaattagttcattccagaagaatgccagctgcggcataatacaaaacgtatttggtctttgtccccagtttctggcactgagcccctaaaacccatggaatttcctgataagggtctttttcatgcataaccagcccttttctaccatagctgagtgtatgggcctcgcaggcctccctcctcccaccacaacctcccgcatctgtaataaaatgttatttatgttcaggaaaaa

SEQ ID NO: 404757 - DNA, 498 bp, Homo sapiens
ctttccactggctgagcttccccttggccaaggtcaaaatcacctcctacttccagcatcttacattccttgagtctaaaagagataatgttaattagaatttaaactgataaaagccattttgacatttttaaagtgtccctttgctaatattacttgttatagaggacttggaaaatatgaaaatgtttaggctgggcgcggtggctcacacctgtaatcccagcactttgggaggccaaggtgggcgaatcacgtcaggtcaggagtttgagaccagcctggtcaacatggtgaaaccttgtctctactaaaaatacaacaacaacaaaaaaattagccgggcgtggtggtgcatacctagaatcccaactacttgggaggctgaggcgggagaaatcgttgaagcccaggaggctgaggctgcagtgagtccagattgtgccactgctgtccagcctgccttcataacagagcaagactctgtcttaaaaaaaa

SEQ ID NO: 404758 - DNA, 468 bp, Homo sapiens
gatatctcctgcaagagatttctgatacaatttagtaaaatgtagtttttaggggagatcttttacagaaggaagcttttatttccaaaggacttcatgaaaggtgtaaaggccacactatgaattagggatgacacaccctgttttgaattggatttcctgctagttctgatccgaggcattcttcccggactagggtgaattcagttccagtgtttgcttgaaaactgaatctggtcattgtatttgcagtttggcttcctgcctgctgttaaagtacagagcaaacttcagctagttactccctatgattctgtgtcctcctaaagagcagggaaagaagagggaaaaacccagggggtgactgagttcatttacatgttgtgccaaagggcagctgcttgctgccttgtcgtcacaagattctgtggagaatcctgatagtccatttaccagaataggagcctg

SEQ ID NO: 404759 - DNA, 895 bp, Homo sapiens
gcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaaaaaacaaaaaacacaacaaaaaaaaaaactttttgggggcgctcgggcccccagaaaaaattttttaaaccccattctggttggggggcgggggccccgggttaggggaccatgggccaaaccggggttccacaagaagaaccgggcgaccgatacactagggcgctgggcttcctcaccaaataaaaagcgcgggggggaacacgagcgcgttcggaagcaaactccggagggaggtcggggaggcacaacgggacctatccaaaagggatcccgaggagccccgaataataaatcccgccgcccggcgatgataacgcagagcacaagaaaaggacaacagagaacgcacgcaccagcagcagaaagaacgaagacagactaagtcacgacggactacgcgcaacgcagacgacaacgacagacaccagaacacgacgaacacacgcaacagacactgcactacgcacgaatatacacacgat

SEQ ID NO: 404760 - DNA, 742 bp, Homo sapiens
gcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaagtatgtatcaagtttttttctggtttccaggttggttaataatgcctgggagctccctcgcttcagcagacagagttaccaggaggttgaagtatgctggctgaaaaaaaatttttttggagatgggatctcactattttgtccaggctgggctcaaactcaagatcctcagtcaggcgcagtggctcatgcctctaaccccagcactttgggaggccgaggcaggtggatcgcttgggcccaggagttcaagaccagcctaggcaacttggcaaaaccccatccctactaaaaatagaaaaattagccaggcatggtggcccatgcctgtagtcctagctacttgggagactgaggtgggaggatggtttgagcccagaaggcagaggttgcagtgagcagagattgtgccacagcattctaacctgggtgtcagagcaagactctgtctc

SEQ ID NO: 404761 - DNA, 1425 bp, Homo sapiens
  misc_feature (441)..(441): n is a, c, g, or t
gcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagatggagtcncactctgtcacccaggctggagcacagtggcacgatctcggctccctgcaagctctgcctcccgggttcatgccattctcctgcctcagcctcccgagtagctggaactacaggctcccgccaccaccacgcctggccgagccaaggaaccaagatcatggtgtggcatagaaaacacagcctgttgaacaagattctgcagaccgcctgcctccgtggatgggagggcctgacaggtgtttatttctccatttcacattaactgggaagcgacagcagctcatggccactgcacccggctgccgtgtggttcatcggacatttcagctgtcttgaaaattgatattgattacttcagaacgtgccgtccatggagcgattcatcttggcagttagagtgggcagaatgattagatcctcgctccacagctgcattccacacttctgcctggtcctaggcttggttttagaggcctcattaacacacgtcatccagtgatcttggagaacattatgctaagtgaaataagccagacacagaaggacaaatatgcctggtgctgcttgcatgatgaatctagtcaggctcaggagcagagagtggaacagtgattgtcaggggtgggatgagagagggagcgtgggggagggggacgggacgggatgagtcagggggtgcaaagtttcaattatacaagatgagtaagtcctagcaatctattgtgtagcgtggacatatcattagcaacactgtattgtatacttaaaattggctgaaaggatagatcttgtgtttgtatcacaaaataataacaataattaattcagagggtggaaagagacttttggaggtgatggatatgcttacggcataaattatggtgaggtttcacaggtgagtacttatctccaaactcatcaagttgtagacataaaatatgtacagctttttctacgtcaattagacttcaataaagtggcttt

SEQ ID NO: 404762 - DNA, 787 bp, Homo sapiens
gcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggcaaagatctgctcaacctctctaggaagaagccgtgtggacagtctgaaatcaacaccctgaagcgggcccttgaagtcttcaagcagcaagtagacaatgtggcacaatgtcacattcagcttgcacagagtttaagagaagaggccaggaagatggaagaattcagggaaaagcaaaaactacaacgaaaaaagacagagctcataatggatgctatccataaacaaaagagcttacaattcaagaaaaccatggatgcaaagaagaactatgagcagaaatgccgggacaaagatgaggcagaacaggccgtcagccggagtgccaacctggtgaacccgaagcaacaagaaaagctttttgtgaaactggcaacttcaaagaccgcagtagaggactcagacaaagcatacatgctgcacatcggcaccctggataaggtccgagaagagtggcagagtgagcacatcaaggcctgcgaggcatttgaggctcaagaatgtgaacgaataaacttcttccggaatgcattgtggttacatgtgaatc

SEQ ID NO: 404763 - DNA, 588 bp, Homo sapiens
accgcgcccggcccaggtttcttatttcaggagcttcataggcatagacctccctccttccctcctaccccctcccccctctcccaactaatgccagaccggccactactttttaactgttttacatatttaaccttcaagaaagatttcctttgatccaagtgtattgcagcccacaaaaaagcttggaaacccagctagatggtctgtttttctagttcctacattggatttaagtcctacccatcgagactactgtcttcaggtaagcatatcgaggctgtattcaccttcatggtgttctcaggggcactttcttacacaaatgatggtaatcatcctagatcatttccctgcctgccacacttgccagttagttagaaactgtaaaccccttaaatgtctgtcaccagggcactggctgaatagctgagtaagttttggtgaatccattccttggactacactgcatccactgaaaacagtgcggtgaatttctgtgtgctaatgtgcaaagatggtttatgtattattcagtggaaaaagcacatttgcactacagtgcagatagcatgatcccatgtttgt

SEQ ID NO: 404764 - DNA, 1093 bp, Homo sapiens
accgcgcccggcccaggtttcttatttcaggagcttcataggcatagacctccctccttccctcctaccccctcccccctctcccaactaatgccagaccggccactactttttaactgttttacatatttaaccttcaagaaagatttcctttgatccaagtgtattgcagcccacaaaaaagcttggaaacccagctagatggtctgtttttctagttcctacattggatttaagtcctacccatcgagactactgtcttcagagggcatcttcatgtgtgggcaccagggctgcggctggaaccacagtggacaccccacgctccaaggacaatcctctgcagaaaccagcagctggaaacaattcttaatgctgcaggaagtagttaggagaaaacgactgtgtaagtcagagctaaaactggagttcaaaaaccacagaaaatatttccaaggctgtctgtgaagtggggatgtcaaaataccaaaaattacagctttggaactgcagtggatgacctttaattgatgcagtttataggtgctaagtattgtgtgtgctttacgttgcctcatgtgagtgcttcatagcagggtgtgacgctggccaagtgatatacctaccctctttgtccctgtttctatcaactgtaaaatgggggttctagagttgttgtgaagattaaatgagctaatacacacaaagcaccaagaacaatgctggagtgcagtggcgtgatctcgggtcactgcaacctctgcctcccgggttcaagtgattctcctgcctcagcctcccgagtagctgggattacaggtgcgccccaccatgcccagctaatttttgtatttttagtagagatgaggtttcgccatgttggccaggctgttctgcccacctcaccctcccaaagtgctgggattacaggcatcagccaccgcaccaggctgcaagatgtttaagaatgggctttgacaagttgatttttaaaattcatagccaaaaaaattgtgaaaaaaatacagtggtgtgagatgtattgtaacagatataacaacaagctgtgaaaatacagtaaattagaacagta

SEQ ID NO: 404765 - DNA, 615 bp, Homo sapiens
catcaggtggtatttctctttctgtcctgtagagggcatcttcatgtgtgggcaccagggctgcggctggaaccacagtggacaccccacgctccaaggacaatcctctgcagaaaccagcagctggaaacaattcttaatgctgcaggaagtagttaggagaaaacgactgtgtaagtcagagctaaaactggagttcaaaaaccacagaaaatatttccaaggctgtctgtgaagtggggatgtcaaaataccaaaaattacagctttggaactgcagtggatgacctttaattgatgcagtttataggtgctaagtattgtgtgtgctttacgttgcctcatgtgagtgcttcatagcagggtgtgacgctggccaagtgatatacctaccctctttgtccctgtttctatcaactgtaaaatgggggttctagagttgttgtgaagattaaatgagctaatacacacaaagcaccaagaacaatgctggatacaaggtaataggtgtttcttcctagacttcactatcctcatgtgaggtgggtatgtttatttatttatttggggacagggtctcgctctatcacccagactggagtgcagtgttgcaat

SEQ ID NO: 404766 - DNA, 1737 bp, Homo sapiens
tactgacctggaattcttttaattgtaataaatatcttctgtcacaaataaatgccacaaataaatgaaattgccattcctaagctgagcacctgtctgtgaaggaccttggtgtcctgactggacagagcattcatagctccaagagaatcatgacaagatatgcaaagcagggataataaggagaaagcccttccctttcgagaagcccttccctttcacagcccttccctgcgattctgcagtgaaaagtgatgcccagagatccacacacagaacccttctaaccagccaggtcaagacttatcatcttatctcctctggcaggtcccctgtaatcaaaagagaggaagtgtctatctaaacaagacccttttgggtccttagattcatggcaaaaatcatcatggcccccatcagaaaagaaaatcagcaataaaccaagccaagcaactaaaatgtataatgtggacctgactcatgttgggaggcagaattcagacactcacagatcaatcttgcaagttttctcttctttaagttgagctgctcaactttatgaactgtgaaatttacttacattctttcaacccacatatatcattgcagtttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttgtaatagagcttatcagatcgcaaatttcctttgtttacaatctcatgtagtagggctcagataatttcttagctataaaccttttctcccactctcatattgtttcatttaaaatatttaagctaagcctaaaaattgaaatcagttaagaatttggagagtttatcttaaatggaaatggtgtattcttttcaaagaattttgtaaccatctttacagtttctttgcttggaaaacttgggttgttaactaccagttaacaatggcattactttccaaaacgttatctaatgggcccaatgtgtacctcaagataaacacagtatgttatgtctaaaaatttccttgtctgttgatttaaatggttctgaaatgtctgtaataaagaaattttcaaagttg

SEQ ID NO: 404767 - DNA, 243 bp, Homo sapiens
tggggtttcaccacgttagccaggatggtcttgatctcctgacctcatgatccacctgcctcggcctcccaaagtgctgaggtgggaggactgcttgagcccaggagtttgagactagcctgggcaacatatggagaaactgtctcttcaaattttttttttctaaaattagccatgtgtggtggtgcacatgtgaagtcccagctacttgtgaggcagagggggtggatcactagagcctga

SEQ ID NO: 404768 - DNA, 1124 bp, Homo sapiens
caggctcacatttccactgtgtccttaactgtagttttcaactccctgtaattctcagtaattagaaaggcctttttactatccttagataaatctctttgtaacttccatgtattggttctgttttttctctctgggtcaacacatcatagccacatgtccctactaaatatttttttacaagtcagtggtagtaccagtttagagtaaagcagatctgttctctttcttgatctgaatactctattaaggctgcttgtcctagtccatgttccttcccaggtctgccagattaatcttttcaaaccagatattcccttaagaagtctctatcttgctagcactagccccttgtcacaagtatcctcttgactcttccagggccactcggatccctgtgtccctaccagggctttactcttctgctttactctgcagggacttgctgacctgatgatctgctctattcttggtttcctattaactctaagctgccccagttactcattttcatccaggcattatactactggctcctcctaatttcagttcagcttggaacctagctctaagtccagaactagaatttattgcagttctggcttctatggctcccgaataaaagagtagggacctcggccacacatggtggctcatacctgcagtcccaggactttgagaggctgaggcgggtggattgcttgagtccaggagttcaagaccagcctgggtaacatggccaaaccctgtctctacagaaaaaaatacaaaaattaggcatggtggcatgtgcttatagttccagctactcagaaggctgaggtggaaggatcacttgagcctggaaagccgaggttgcagtgagccaagatcgcaccactgcactccaacctgggtgacagagccagaccctgctgcctcaaaaaaaaaaaagaaaaagaaaaaaggagtagggaccacaatcagttgctgaatcctagtgatctgctgttcaagtcgcctcaacctgttcccttttcttcattccccagctctgaccctcactaatatgacaggcaagttccttaacttctctaaacttgttttcttatctgtgaaagaaatataacatccaccttacagat

SEQ ID NO: 404769 - DNA, 333 bp, Homo sapiens
cttttaatatccttagtttcaaaggttgaaattgatcaacccatgtaagagcacagctgaacttaaaggagttgacttagttttggttcatcctttgctttctgatcaggggctgaaagatcgtaatgtgacagaggtgaggaggaagacaataacttatatccccagtgacaaagtccagggtgcacaacagatgccctgctagacgctgtcaaatacagcttcacctggagatgcagcgtaagaaaatgtatggttctgggaactttaaacccctcaggaagcactagatgcaggcaggaaggtgatgatttatgtgagatctggacacag

SEQ ID NO: 404770 - DNA, 525 bp, Homo sapiens
atctgtatactttatgcggcagctgcaatgctcagccacaaactcaaacacactgagaaagatcacctttgtcatttccttaaaaagcaatgtaattttaaccctgagtccccatgccaccagatggtaagaaatttcatttcattattagggaccctccactcccaggattaaatgagaatccaggggtcaagtggtctcagaaaccagaccagcctctgacgtccagtgtggctgggtggcccctgccaccttcattgtcaaagcctgcagtcgtcactaaaagtccagccactctctggtgtttccatgctatacaatgggtatggaaatctttgttgagcctgagaaccttgaaatatttgctacaattctttggttgcaagcaacagaaaccagtaccgggcccagcacagtggctcacgcctataaccttaccactttcagaggccgaggtgggcagattgcttaagtccagtaatttgaaaccagcctgggcaacatggcaaaacaccatctctacca

SEQ ID NO: 404771 - DNA, 215 bp, Homo sapiens
ccgctcagagttcaacaaggttaattacggcttgagatcggagacctcgcaacaacactcattatcccttctcagtcaaccaccatcagcactcagaattttccagtgaggctggtgggttctaacagaaatttccagaatgttggactccaaaaataaagcagtttcccactgggttctgtacttcaagcacagaatagaccattttgccagag

SEQ ID NO: 404772 - DNA, 854 bp, Homo sapiens
gctctgtgaagtatagtagccctactggttatgtttatcagtttgcacctaaaaggtgaaaggaaggcttgctttcttgtgatgtaaattttttcaactaagggagtgccagaaaactgctggctgctttctctcccgtgttggtttctctccagtgctatccagaatatgctgtaagctctggacttcctgaaacaaaggtccaagtaagcatctggtctttgatgtactttaaaatgcaccccacccccacatgaaagataactaaatttttcaaaatattaatacttcttgaatgtaaatcgtgtgtctaaggtactggcataattttttttttcaaattttctatatgtttgaaatgtttcataataaaatccttttaaatttttttccatgtgtaattttaggatgatatatatatagcacatggaaaaaagcagggcatagaagtatttccactttaatttcagtttcataaaatcagagagaaaaagtcatagatatatacaccatacataaaaaataaaagcgtaaataaatacagaaagaaatctaaagagaaatcaccatagcagtaaaagtaaattctgtgtgaagtggttataagagacactaagagttgcccctccttgaaattatatttagttatggtccttaagtcactattatttgtaaccaaaaaaaaaaattgaataaaaatagttctccctctttagtccatccaatcctaaagaatttttatcagtgccctttctttttcttcagagtcactctgtcacccaggctggagtgcagtggcaccatcacagctccctgcagccttgacttacagggctccagtgatcctccaccct

SEQ ID NO: 404773 - DNA, 425 bp, Homo sapiens
ttttttttttaaattttgaaacagggtctcactctgtcatccaggctggagtgcagtggcatgatcatggctcaccatagccttgacctcctgggctcaggtgatccacccacctcaccctcccaaggtgctgggattacaggcatgagccaccgtgcccggcctcttaccacaattttaatcgaactatactcttttttcttttctgggtgacagagtgaaactgtgtctcaaaaaaacaaacaaaaaaaagagatgaaggtgtaaagtagtaacagctgggcctcaaagtgaccataaacaattctttcaagtagaaggagaaagggaaagaaagcgtattctcccctagaaagacccagcatttcatgatcctgtgcccaaactgattagaggaaggattggcaaactttttctgtaaaggg

SEQ ID NO: 404774 - DNA, 353 bp, Homo sapiens
ccagggttcatgaaccctctcacctcacagctgctcgggggtccggggttcacccctcttacctcacagcagctcgggggtcaggggttcatgaaccctctcacctcacagctgctcgggggtccggggttcacccctctcacctcgcagcagcattcctttgattttctgcgttcacagcttctatagctgggttagtggctgcaccctggggatgatcactgggctccctagtcgcctccacctcctctgagccgtgtataaggaccaggctgacacggagcctcagtgtggacacaccttcttgtccaggcatttcccatgccgactcttcagctgggcccctccctcgc

SEQ ID NO: 404775 - DNA, 1122 bp, Homo sapiens
tgagtttcacttgttccttcaaggccagtttttggggcgggggaatactgtttaaaggtttttaaatacacctgacctgcgcctcagaccattcacagtatttgaggaaatgtaagagacaacttattcccgttcttttccgagctcggctgtcgctgaaggccctcttacgaagaaaccgttctacggaagcccagttgagacaacttgagacaggattcagaaacgctgattttagtaaccttaaccctcggcccttggtgggaacttcggctctgtgggaattagtctttgggggactgatggtgatgctgaaatcttattgcgtaggaaattaagtacaacaaagaagacccgtcgtgagaggagagtgcggaagaaatgcgaagtctacgggaggtggcagctgcagaagcttggtgttggatttggcgttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttactaacaccacatctcacccccacgaaacttggtaagggcagcaacagaactttatctgccatatgcactcctgtattcctattaccaaatagtgccagggactaagtgaatatttgcccaatgaatgagttttaagtaggaaacgtttgcatagaatcattttgtttcttttggagttcaaatcttcggatattttacccttcccaatccaaagaaaagtctctgagtgaagagatgggaacaaaatgtaagttaaatatgttgctttaacaactgtttattgaactcgtgctatatactgtagaatgatgagcaaaaccaggcacagtttcggccctggaagaggaaaggcaggcatatatttatcaagtaagtacattaatggcggcacttatcagttgagagaagtgcgctaaggaaaggaatatgattctatgatagcgtataataaaagttccgttgaagccgtggggaaac

SEQ ID NO: 404776 - DNA, 734 bp, Homo sapiens
tgagtttcacttgttccttcaaggccagtttttggggcgggggaatactgtttaaaggtttttaaatacacctgacctgcgcctcagaccattcacagtatttgaggaaatgtaagagacaacttattcccgttcttttccgagctcggctgtcgctgaaggccctcttacgaagaaaccgttctacggaagcccagttgagacaacttgagacaggattcagaaacgctgattttagtaaccttaaccctcggcccttggtgggaacttcggctctgtgggaattagtctttgggggactgatggtgatgctgaaatcttattgcgtaggaaattaagtacaacaaagaagacccgtcgtgagaggagagtgcggaagaaatgcgaagtctacgggaggtggcagctgcagaagcttggtgttggatttggcgttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttactaacaccacatctcacccccacgaaacttgccaagcccaacaaaataatggcacacagcagttgctgcccaagcctgggtgctccttg

SEQ ID NO: 404777 - DNA, 1029 bp, Homo sapiens
tgagtttcacttgttccttcaaggccagtttttggggcgggggaatactgtttaaaggtttttaaatacacctgacctgcgcctcagaccattcacagtatttgaggaaatgtaagagacaacttattcccgttcttttccgagctcggctgtcgctgaaggccctcttacgaagaaaccgttctacggaagcccagttgagacaacttgagacaggattcagaaacgctgattttagaaattaagtacaacaaagaagacccgtcgtgagaggagagtgcggaagaaatgcgaagtctacgggaggtggcagctgcagaagcttggtgttggatttggcgttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttactaacaccacatctcacccccacgaaacttggtaagggcagcaacagaactttatctgccatatgcactcctgtattcctattaccaaatagtgccagggactaagtgaatatttgcccaatgaatgagttttaagtaggaaacgtttgcatagaatcattttgtttcttttggagttcaaatcttcggatattttacccttcccaatccaaagaaaagtctctgagtgaagagatgggaacaaaatgtaagttaaatatgttgctttaacaactgtttattgaactcgtgctatatactgtagaatgatgagcaaaaccaggcacagtttcggccctggaagaggaaaggcaggcatatatttatcaagtaagtacattaatggcggcacttatcagttgagagaagtgcgctaaggaaaggaatatgattctatgatagcgtataataaaagttccgttgaagccgtggggaaac

SEQ ID NO: 404778 - DNA, 337 bp, Homo sapiens
caaactccatctcacgtatttgttcattgtctatttctcctcctgcatagaatggaagctccatgaaagcagaggagaaactgcttatcttgttcgctgctgtttctcgagtagccacaagaacttggcactttaggtagtaggtgttcggtattcaaatgatggaattaaagatcaactctgaactctcaaaggcagatagattttcactttagtgcaggaaaataaacactcatatgtcatgcccattcttcaggcctgaaccaaaggggaacctgtcagaggataggaaatgagatctcagcagcgtctgttactatttgcaattttcaaatac

SEQ ID NO: 404779 - DNA, 465 bp, Homo sapiens
tttagtgcagaatcagtcctggtaaggtggttgaattaatgacatacatgaaaaatatgtgaattcatgtctcgagtttatgatttgctctctttctgtgaaaaagatagattatgtttttggttttgttttgccctgccagcttccaagtaaccacttactgttaaattggccccagtacacttcagtgtttgttgcaaatggaaagaattgattcactatatttttttctgctgctgaatcactaagcaaaactctaccgctggggaaacttttgtatcgcagcacacaagcagcccagtatgatggtaaagaccaacctccattgtgtggtcttaccattgtcactcgcgttacccacggactgaatagggtttagaaatacaggccttcaaaggaattgccgttgcttaaatgttccatggctgcttctgaaataacatccctccagccctcattcaaaac

SEQ ID NO: 404780 - DNA, 754 bp, Homo sapiens
gccaacaccaaagggggcacgggagaaggacaggaggggtggtttccctcagcaagctctcagtcccactgacactggcccaagagggctgagtgtactgggcactcacgcagggagattgttcccgaaggccctcgggaaagttggtgaatgcaaacagcaggcagccagagagcctgctgcagaggagaccagagacgatgccccaggagggcacagaagtgtgcaaaagactcagcagtgggaaggagcctggtccgtgagtgtgaggagataacccgggccctaggcccttcctgccccaactttccaccacctggcccagccccttgcagcggtgaggcttagcatctctctgctgggtttgtgagagcccagactgccccagtgagggtacaggagtactctccccaggcaggaagggtgggcggcctccctccaggtacccaagaggaaatgttagcagctgaaagccccagagcagagctgttctcatggggaaggaccctgtcttccccatcatcctaggcgttcattgaggatgaggactgtcttcctccatcagaccgagagttcccaagggcaagggctgtctctccctggtcagacagggagctccccgagggcagaggtcctgtctcctccatcagacatggtagcccccacaaccacaaagctagtgtctactttcatcagaaggagctccctaagtggggaagggttctccctattttccccttccaggtgggaactt

SEQ ID NO: 404781 - DNA, 619 bp, Homo sapiens
gatataagaagaatttttgtagatgacagcttcaatccagggaagagatgatggtggcttggaatagggcgttaatagtagaggtcaaaagaggtggtcagctttagatatattgtgaaggtagggtctaccagatttgctaatggattggatatgggtgctaaaagaagaatcaaggatgacttcagggtttttggcctgagcaaccagaagtatggcattgccatttactgagttggagaagactgaaggagaagcaagtttgggagggaagaccaagaattcagttttggatatgctgagtgtgagctttaattagatttctagatagagatgtcaaataggcagttttatgagatcacagggagtgaggacatctaagaaaggcgaatggtccaaggaaacttcttccccttaaaaaatgagtgtacagctaaaatcataagcaactttaaaggcatagattgaaatagtataaaatgtagaaaacctcccataccttgaaagctcacttcaactgccttctgcccaacttaacattttaaagacattttgatatacatacaaatctaagctccaagaagcctaagaaaaccccttaggggttaccttggctcat

SEQ ID NO: 404782 - DNA, 730 bp, Homo sapiens
ctactactactaaattcgcggccgcgtcgacatcagttgaagacactgagtttccagtttttgaataaagcttgccataaacattcacatgcatgtttttgtgtgaacacaagttttcatttttaggaaggggattgccgggttatatggtaagtgaatgtttaatttataaaaaatctccaaactgttttccaaagtgggtgaaccattttgcattccagccagcaatgcatgagagatccagttgcttagcatccttgcaggacttgatatggttagttatagaaattatagtcattctaaaagatacatagtagcatctcattgtggttttaatttgcattaccctcatgagtaatgatattgagcaccttttcatgtgcttatttgccatttgtacctctttgttaaagtgttcattgaaatattttgcctatttaaaaattgttatttcttgttgagttttgagagttcttcatataattctgaaaataagtcccctggcagatacgtgctaatatatatttgcagtctgtagctgtcttttcattctccaacaatgtcttcggcggaacaaaagcttttgcttttgatgaattcatcgctttaaaaaaaaaatagattgtacttttgtgctgtatctaagaatttgcctaaaccaaggtcatgaaaattttctcctgtgatctctttacttttaggtgtgtgacccattttgactcaggttttt

SEQ ID NO: 404783 - DNA, 290 bp, Homo sapiens
accaggcacagatggtgttagagatgaattctttataaccattagtgaatatataattattttcaatgtaccaattctagtctgtagagaaacgtgaaaacctgaataaagttagaatagccttaattttaaaaactctcaaagataacaaaaacaatctttgtactttttgaaaggaaggtatctatcaagataatccaaagtaccaaacattatagggaaaaaatataattattttaatgattgccatagatgtatttgataaaattcactagccattcaaaaaaaaa

SEQ ID NO: 404784 - DNA, 396 bp, Homo sapiens
tcactacgttgcccaggctggtcttgaactcctggcctcaatccatcctcctacctcagccttccaaagcattgggattacaaacatgagcaatcactcctgggcccttctttactttttaaaactacattattgtagtgactttctccacaccaccaagaaagtcttatttgaacgctttttgttaatttaagctattaaactactttactggggatgggtgtatcccaggcaatgtgttccaggatttgcatgcatcatctcatttaattctcacaacaacccaccagtagataagtatgttattccttctactgtaaagatgaggaaacagactcagaaggtcattcaattaaggggcagaattgagattcaaaccgaggcagtctgactcca

SEQ ID NO: 404785 - DNA, 466 bp, Homo sapiens
tgttaggggagattttccactggactagaatcttttcagcaaaaataacccatagacagttaaagtgaacacacacacagatactaagcgagagttgtttatgtgagctgcttttatgaggtctctattgagaactacctgaatgttctctttggcagggggctgcccttggggcggagggctggtattccctgcagatgcacccccctgcctcacctgctcccctcttgcctcccagctggtaagatctgtatctgttagagaattgagtccttcccgccagaggtctgctgagtttgccaacacaggcatatcttaaaatgttttattcactttgtctgtgactcagaaggttcatttcatccctgggaaaccacttaccatgaggcagagaccctggcatctgctggcttttctgcagcacaccagcaatactacaggactctgatgggaacttactaaagaa

SEQ ID NO: 404786 - DNA, 663 bp, Homo sapiens
ttttttttttgatacagagtctagctctgtcacccaggctggagtgcagtgacgcaatctcggctcactacaagctccgcctcccgggttcatgccattctcctgcctcagcctccagagtagctgggactacaggcgcgcaccaccatgcctggctaatttttgttgtatttttagtagagacagagtttcaccatgttagccaggatggtctcgatctcctgacctcgggatccgcccacctcggcctcccaaagtactgggattacaggcgtgagccaccgcgcccagccgcattaaatcctcataggagcttgaaaacatccccctcagcaccctgtccatggaaaaattttcttccacaaaactggtccctggtgccaaaaaggctggagaccactgccttacaacacccctgcaaagtacaaactattattttacagctgaacagaatgcagctcagagaggttccagtgacttgctcagctgaagagaggcagagctgggaatccccatccaggtctgtcagccccacaccagccagaaccctggaaatggaaggcttgagtttggattccagctattccaatcatggcaaaggtgtctgcaatagtcataacagtgatttttaaaaaaaagtaccaagcacttgctatatggcag

SEQ ID NO: 404787 - DNA, 815 bp, Homo sapiens
aagttcagtcatttttatagagaaagctaaccagtaaagtagatatggaaagtctttgagtttgtgctgacttgaataaacctgggatcatgtatccatgtcaactaagaattatataaaatgttttctctccaggctcataccaatcagaatagttaacttgagaattaattgcttccaactaacatgcatttattataaattatccaaaatgaaggatttttatattataaatattctgttataaatttataaagaatatgaaatcttttaaaatgtctaagttaaactttatagataatgaaatggaattgtgatagaagttatatttatacagatcttacatgttaactctgtgaaacaaagggaaaaattcaagtttggtctttgatgaccaaagtagtatgaaattatttctcaaagtttagcaaaaacatgcatagattaaaaattaaaacccaaggaggagactgcaaaggaaaataatgaaaagacactcactcaaatgccagattctaatctaggtcctatatggcagagaaaaaaaaggaatttcttatatagattgtattttaatagtgagagacaaaaattcaactgataagaacagatactacacttgatcttagccaaaaggctgagaagcaaaaatgtaataattaaatttataatatgttaaaagctgataatactatggtgaaaaatcaaggcaggtgcaggagagtgtgtgtaggtatttaattttcaggtaggattgtcaccaaaagctctctcagtatttctcataaacttgagaagtaccttcttttttataa

SEQ ID NO: 404788 - DNA, 379 bp, Homo sapiens
ctcaaatttcaattattacttctaacacccaaggagatctatggagatttccatatttaaggtcaaaataacctaagaataaaaaataaagggggggagagctaattcccagaagaactaagaggagataacccaagaaaaactagggcttctctatttctgtgaagacaagaattagcttttgggattatttctgattttataacctccttgcattttgtttttatcattggttttcctagagtttgataatagccaaaaacacctcagaatttagtttgttgctttcttgaggacaggataatggagataaccatcagggaggattgagggatttggcaaagaagctttgtagctttgtgccattcttcagtgtgcc

SEQ ID NO: 404789 - DNA, 1027 bp, Homo sapiens
ttggcaacaccattatgacatcacaacctatttccaatgagaccatcataatgctcccatcaaatgtcatcaacttctcccaagcagagaaacccgaacccaccaaccaggggcaggatagcctgaagaaacgtctacaggcaaaagtcaaagttattggggtgcatagcagcctggctggaagcattctgagtgctctgtctgccctggtgggtttcattctcctgtctgtcaacccggctgcattaaatcctgcctcattgcagtgtaagttggacgaaaaggatataccaaccagacttcttctttcttatgattatcattcaccttacaccatggactgccatagagccaaagccagtctggctggaactctgtctctgatgctggtttctactgtgttggagttctgcctagctgtgctcactgctgtgctgcagtggaaacagactgtctgacttccctggttactcatgtcctcaaagacgactcatgatgctggatatgaagaactattgacttcttgggaaaaaacggagaaatattaattggaaagttgatttttatgataatatggaaaacctaaccattataaaaaagcaaacttgagtttcctaaatgtaagcatttaaagtaatgcatatttgttttaaaaaattatttcgctgtcatttatgatatgtgttcattggggatctcttggtttgcctgatactgacttcagcaaaagcacagggctgtaaattaccatttactagactagccaaatagtcttagacatttcccagaaaactaggcagaatgatgattcaatggatcacagtgaggcaaaggatacagctttttcttatactcctcaattgtgaacaggagttaactgatttgctgtggtgcgcagactcttttatcacaggtgctactgatttatcccatgtattttactcattagtgcataaaggcaaaccccataatgaagtctccgagtgtatgaaagtagccggcttcaaaataaaatctttgagtgcat

SEQ ID NO: 404790 - DNA, 329 bp, Homo sapiens
gctggggaggcttcaggacagtctctgaactactgagcattagtttctttatctgtccaatgggcccaatggcacctgctctgctcatctctcaggatcttacatgccacataagctaatggagaagtaaatgctttataagcctaaaggaatggacatgggtgcattcagtgagaggcagtaggactaatggttagtgattagtttgctaagtaggagcagcagttgttagtgtaagaagggcgggttagtacatgggtggtggtcaggaggagcaccactgctgctgctacttagccacttgtgtaacctttttttttaaacaaaac

SEQ ID NO: 404791 - DNA, 386 bp, Homo sapiens
cttgggggtgatctgccttagaaattcaactttaggattagaattctgctaagaggtaccatgtgacaaaaaaggtagtgtaaaaatcacaaagaccaggacaggctcatgcctataatcccagcactttgagaggccgaggcgggcagatcacttgaggtcaggagtttgagaccagcccagccaacatggcaaaaccccatcgctactaaaaatacgaaaaattagctgggcgtggtggtggacacctttaatcccagctactcgggagcctgaggagcctgaggcgtgagaatcacttgaacctgggagacagaggctgcagtgagctgagattgtgccactgcactccagcctaggcaacagagcgagactctgtatcaaaa

SEQ ID NO: 404792 - DNA, 700 bp, Homo sapiens
ggcaggggatggacagactctaggagaagaccaccttctcactccatcgcctttccagctcccattccccctgaaagcctgtgtcataggcaataaaatcctctgtattcatgacccatcaatttgttcgtgtgacctatgacccttcaattcgttcatgtgacctgattcttcctggatgccaagcaagaacttgggagccacaggtgtgggtgcttgagctgtttaacatttaagccatctatggatggcaaagctaaaagaacacacagtaacacaccctctggggccccaggggtctcaggtaccctcctagatgctgctgtagggctgcacggggttctgttcctgctggcgcccagaagcactcgtcccaactcctgcgcctgctcacctgcgtgctccctgtcccagctgagagctgcagactgagtaagtgaggcacccttgtctcaaggcctgtgaaggggtcaaagagaatttcccatctgggagatgggaatttcccatttcccatctctctctctctggtagatggtcaataaacatttgttgcttaactaaatggacatgataaacatgttgttcattaaggagtgagtgttggtttccagagtagtcactggggattcttgtttactggacttgactgatgaatttccaaatgaatttgaaagttttcaaaatcaaattcagcctg

SEQ ID NO: 404793 - DNA, 702 bp, Homo sapiens
gcacctgctgcagacggccgggacctgcggggtcagcgacgacagcctgggcagcctcctgggaccccggacggcagccgtcttcaggcctcggcccggggactctctgccatcccgagagacccgctacgtgagagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactaccgtggggtttgccagggtgtccgccatgtgctcccacagctcaggggctgtgaaccaggaccacagcaagaaccccgtgggcgtggcctgtaccatggcccatgagatgggccacaacctgggcatggaccatgatgagaacgtccagggctgccgctgccaggaacgcttcgaggccggccgctgcatcatggcgggcagcattggctccagtttccccaggatgttcagtgactgcagccaggcctacctggagagctttttggagcggccgc

SEQ ID NO: 404794 - DNA, 913 bp, Homo sapiens
aatcctgtgcgcgtggttcttgtgggaactgcgcctcccagaaggcaccgcgcgtcgtccttctccctccctgaaggccgcctcgcttgcccagtgtgtcggccgcccgcgaactagagtccactgacttttccgccaccatgttgcccgcctcactgcttcgtcacccgggcctgcgccgcctgatgcttcaggcgcgtacatacgcgaggccgccgctgcacctgcccccgccgccgggcccggacagatgtccttcacctttgcctccccgacgcaggtgttctttgacagtgccaacgtcaagcaagtggacgtgcctacgctgactggagcctttggcatcttggcatcccatgtccccacactacaggtcctacggcctgggctggtagtggttcacacagaagacggcaccacgactaagtactttgtgagcagcggctccgtcactgtgaatgccgactcctctgtgcagttactagctgaagaagctgtgacactggacatgctggacctgggggcagcccgggccaacctggagaaggcgcagtcagaactgtcaggtgcggcggacgaggcagcacgggctgagatccagatccgtattgaggccaatgaagccctagtgaaggccctggagtaggtggtacctactgtctgacacccacggggaaactgagccaggtccaggccgatgagaagttcccagtgggctgaagtggccaccaggggtcagcagtgctccagttgctgggcttaaagcttcctggtgcctgtctgccaggtcatggaggattccccaatctggcatccccacgatgcctctggagagatggccttgattgcccctcaaagccacctgaaccgtcgtcaacttacccagcctgtctccattaaacaccaggaacca

SEQ ID NO: 404795 - DNA, 618 bp, Homo sapiens
tgagacggagtctcgctctgtcgcccaggctagagtgcagcggcacgatctcggctcactgcaagcttcgcctcccgggttcacgccattctcctgcgctcagcctcccaagtagctgggactacaggtgcccgccaccacgcccggctaattttttgtatttttagtagagacggggtttcactgtgttggccaggatggtctcgatctcctgacctcgtgatccgcctgtctcagcctcccaaagtgctgggattacaggcgtgagccaccggacccggctcttacgttctttatggcagaaacctccatgaagaactttgaggaatcgttagctgctcccctacaacactgttatcagagtgagagcaaattttgccatgtgtataggcatttattaaataaatactcatttagaaataggttctgcaacctatttttcaaactgagtaatgtgcccagctctttgtcattttaggtgtctgacatctgtgcaggatgtgacattacagaagcagggtttgttactcttagaatcggcatcaggcaacagaagcttcctaagccaatgactggacacaaatggcccgggcagcattcctttgtgatcagatgcag

SEQ ID NO: 404796 - DNA, 551 bp, Homo sapiens
tgagacggagtctcgctctgtcgcccaggctagagtgcagcggcacgatctcggctcactgcaagcttcgcctcccgggttcacgccattctcctgcgctcagcctcccaagtagctgggactacaggtgcccgccaccacgcccggctaattttttgtatttttagtagagacggggtttcactgtgttggccaggatggtctcgatctcctgacctcgtgatccgcctgtctcagcctcccaaagtgctgggattacaggcgtgagccaccggacccggctcttacgttctttatggcagaaacctccatgaagaactttgaggaatcgttagctgctcccctacaacactgttatcagagtgagagcaaattttgccatgtgtataggcatttattaaataaatactcatttagaaataggttctgcaacctatttttcaaactgagtaatgtgcccagctctttgtcattttaggtgtctgacatttgcccggattggaccatttcccaacccggggtttggtaccctttggcccgggcacgatttc

SEQ ID NO: 404797 - DNA, 437 bp, Homo sapiens
tcagtactttatagtaagaatatagcttacttttttttccctaaatacatgaatgacttgatttccaaaactttgccagcccatgcagctttacttctagtttgttgttgttgtttgttttgttttgccatgccaccctgatcatagtccagggaagtacaactttttacatactcaacaattttgttactttgagatttattctgaggacaagcatagtgacaaattacacctcagtatataccaatgccttagagccatctaaacatccaggagccgtaagaatcacttagcactgcaggaagaaatagttattttgagaattcagtttgccatctgactaatactgctgggataagccttttgtgtcagagagatgacaagccatcaaggaaaagagagagaaagttcatggaaaagggcacacaaaatattta

SEQ ID NO: 404798 - DNA, 566 bp, Homo sapiens
  misc_feature (532)..(532): n is a, c, g, or t
tgctcttggtataaaataatgatagagcttttgtcttgaatattcttttgtgttttttaatattgtattacaattgagagcctagatttgtttgcttattgtgcatgtatttacagaccatgcaaaaatccatcatccgtagcctggccttattatccagtgggtctcacataggcatacatttagatcaactcagcaaatacttattgaacatttactgtatgtcgaccactaatgtaggggtgcaaagatgaaaaaagatactgatgtggcccttagatgttcatagtatggataaattgaaggaaaaccagacactttagtttgtttttggcagaagagtaacttggtaggtcttttggacagaacaagagcaatacacattcaagtaatatatgtatatgtgtgtgtatatatatgtgtatatatatgtgtgtgtgtgtatattgtgtgtgtgtgtgtgtgtgtgtgtgtatgtatattccccccaccaagactctgtctcaaaaataagcaaataaataatttttanagctagcactcccagcctatggaccagctagcta

SEQ ID NO: 404799 - DNA, 727 bp, Homo sapiens
  misc_feature (259)..(259): n is a, c, g, or t
agcgggccttctctctgcttttggagaaagggaatacacgataaagaaggagacggaaagaagagaaaaagtgaggcgggagacagagggaaaagggcgtgaacagaaagggccggagcgtgcaggggagcacagggcgcgggggcggcactgccgagccgggagcgctgccgcttgggcaggtgccgcggccgctgcccggaggcggcatgtgacgcgcggccgcagctgcccgcgggcggagcgctctcagaccccngagcgcacaccgcggggcatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagtggactgtggattgaatgaactgtatccatccccatcatgatgtacagaaccaagtctcttcactagtag

SEQ ID NO: 404800 - DNA, 477 bp, Homo sapiens
agttaccttgtcaatttattttcttataatttgcatgtcttacaaaagtagactacagcaggcatggacaaaaacagaacaaaagtctaactgattgaaagcttattccatagagaagacattgggttctagagacttacaggctatgcttgtagtttctcatatttaccttccttttgttggaaaatatagcagaaaatagagtggaggagggtgagaaggtgaggttatttgtgtgaagaatggttaggatcagtttgtttacctcctccccatccgtaccactttttggaacagttatctgtaaatataaggataaagtagtctgaacctgggtacagaagaggagaacactaacaagacaggcatctgatggtaataccaacagctttttccccaaacctaagttacaactttagtgatcattatgttctaattgttatagaaaaataaaatgtgaaaatactagttacaaca

SEQ ID NO: 404801 - DNA, 478 bp, Homo sapiens
ggttccatcatcttcaatctgtcctaagcctcagtttccccatctctaaaatgaggataatagtacctacatcataaggtggttctgagtattaagtaagatgatccatgtaaagcacttagcacaatgcctggcacacaaaaacactcagtaaatattagctattattttgcatagatttatttacctggtttggaattttgaggatccacctcaaaagctgatctttgtaattttcctgaagcagggctcagaacagcccacttgataagagacagagtatgtgagtcttatcaaaggagtgaacccagctggtcactctgcgtggtatccacagctcaacctttgttgttttcttcttcccatcacctataaggcaactcctatgaagatttttgtgaggggttttttaactttaaatctttgtggaaaaaaaaagaccctaaccaaaaaaaaaactgatactgccagaagtaga

SEQ ID NO: 404802 - DNA, 413 bp, Homo sapiens
tatttttgcatagttgactttatatattaataacttcacatcctgaaaatgttaaaaggataaagtaataaatacttgtgatactagagtcttttaaatctgcttctcgaatactgtatgaattgcatggctgatattctcttaagtatatgatattcccttaagtatatgtaatttctctgaaaagtttgacaagcatcctactttttggtaccaaaactaaatttttaatagtagacaaagattcttaagttctctgtatcttttttagaaatttaggccaggcgcagtggttcacgcctgtaatctcccagcactttgggaagccaagacgagaggatcgcttgagtccaggagttcaagaccagcctgggcaacatagtgagacctcgtctctataaaaataacaaata

SEQ ID NO: 404803 - DNA, 337 bp, Homo sapiens
gattaagctggcctcctagggttagtatgaaaaatgctacatttttgttcttggaccttaattcctctttccctcatttttgtcatgtttgcaaatttcatttgcatttaatttcctgtggtttgccaaagtccagactgagacttgagctgttgtttttattcaggtgagaagtgcaactgctactgaccatctgcactggcatctagtcaagcgattgtctgaggaaaggattttggagattcccatctgatattcttctatttggtctcttgtacccattgtcatcctgtaccacacataataaagtttaagaatgtcaagcaatccatctgca

SEQ ID NO: 404804 - DNA, 343 bp, Homo sapiens
tttgaaactttcaaggtttgacctgttgagctttagacccaaaattccaacattatgcttattttggtagagataaaacatttgtgtaataaaatgattatctggaaaaatttgaatgtgaaacaatgagaaaaggtaggcatatgcacatggttatttgctagtttatggaaatcagcttatataaaaatgaactctatttctcttcaactttttctggaccttttaaactgtctcctttttgtttgtttgtttgttttttgttttgttttgtttttttgagacagagtcttgctctggctccatcacccaggctggagtgcagtggtgcgatctcggctca

SEQ ID NO: 404805 - DNA, 657 bp, Homo sapiens
aattcaggcaacctgtttataagtagcagaagcagtattaaacatcaagacttttcttaagccagtgctctttccattaggtttcaagtgcttataaattttgggttagcctcttttgagtgggttggtagggaatctgacgttattttgaaagaacagaggaaggcctgtttggaaccccttctttcagtccttaaagacaagtcttattctgttacatcgtttagggctgaatttataatggggggaaggttcttagaggagaacagctgtgcatccctgggagttgggcagaaacaagccatacttgtacacttgtacactcagtttagggataacttggggtgtttgggctttatccttttaggattattaaattatatgtctgtaaggatggtcaatttacatttggcaagatagtccaaatgggaggaaataatggcaaatccactgatgtcattggtgctgtcacccatgagaaggaaagttcctactctctctgaggttcctcttgtcatctcttagacagctacatagaaagtcaattcagttaataggaacctgtagatgattgttaatatcctctgatcttgcctctagttacataaatacttaacatgccctggttttctgtctgccctcctcattgagattttg

SEQ ID NO: 404806 - DNA, 413 bp, Homo sapiens
ccagaaaaggatttctgtgcacaatgcagttgcattttcagaggcaagaccgtgagagagagccaactgagactcacggtgacggcggcttccagatctgcatgtgtcacacgaaaatgaggtcacagaggtgccgctgtcaagtagtttaatcatagtccctaccgtgtgtacctaaagaagagaactgtccttccctggacaaaccacccaccaggtcgagactccgatccagacgctccctgcacattaccagggtctgtcaccacccgctttgcttctcagttctgtgtgacaccaacgcccagggcccacaggggacgattatcattaaccagtttgtcctttctttgaccacataactctttgttttcaatgttacttatgaatattgagaaaaactgagccgaaaa

SEQ ID NO: 404807 - DNA, 458 bp, Homo sapiens
accacatctggcaaatatatatatatatgtattagagatggggtcttactatgtcgcccaggctggtctcaaactcctggcctcaagtgatcctcccacctttgcctcccaaagtgctgggactacaggcatgagccaccacaccccacttattccttattttaaaaatagctgcagggccgggcacagtggctcacgcctgtaatcttagcactttgggaggctgaggtgggcggatcacgaggtcaggagatcgaaaccatcctggctaacacggtgaaaccgcgtctctactaaaaatacaaaaaattagccgggcgaggtgacgggcacctgtagtcccagctactcaggagactgaggcaggaaaatggtgtgaacctgggaggtggagcttgcagtgagctgagatggcgcctctgcactccagcctgggcgacagagccagacaccgtctc

SEQ ID NO: 404808 - DNA, 513 bp, Homo sapiens
cagatactgagcatttgaaataacacagcttgcagcgtccttgcggagccctgtttatggggcaataaaccatttaaacgactgtgtgttggaacccacaaggtcgccttgaaaggcttttcacagacactgctagtagggctccaggacgtctggagggccaggatggggtgtctttttggcttctgcttgaagctgctggttcccctccatcaggaacgccagcccctggagaggctgccatgagaaagccagtttccacgtaaagaaatctaagcaacttgctagggaggccacatggagacagtgaaaccccagaggatgagaaaccacttgaaaaagagcgaaggcacccagtggacagccagcacccgccgccggatgtgaatgaggctgtcttgcattcctaagatgctgcagctgacatgaggtgaagcaaagatgagtgtcccagctgagcctggccaagctcctgactcacggaatcctgaaaaataaatggttgtcatttta

SEQ ID NO: 404809 - DNA, 743 bp, Homo sapiens
ttttgctgttattcatattatattgattattctgccccagcctgtgagccgtgtcaactcttagaggaacagcaatagagcacaggaatggcacatagaacatgggctctgagcacaaaaacgagctgtgtaactcaagttatttaaactctctctgcctcatttgcctcatctgcatactggggttactaacagaccctacctcatggagtttgggaggattaaatgagttcatccgtataaagctgttagtacggcgtctggcacctggtaagggcccagatgtccactgctgtagtgtattgcagtagattgtttccaaaggtggctgcaacaatttgtcccattgaaatatgaagagacagagtctgtttccttccccttgaatcttggctggccctatgacttgtggaagaagtgacgttctgggacttctgggccataagagtccttgcagcttccatttttaccctctagaaagccagtttccacgtaaagaaatctaagcaacttgctagggaggccacatggagacagtgaaaccccagaggatgagaaaccacttgaaaaagagcgaaggcacccagtggacagccagcacccgccgccggatgtgaatgaggctgtcttgcattcctaagatgctgcagctgacatgaggtgaagcaaagatgagtgtcccagctgagcctggccaagctcctgactcacggaatcctgaaaaataaatggttgtcatttta

SEQ ID NO: 404810 - DNA, 294 bp, Homo sapiens
cattaaagctcatggacttaattcctgtctccagggctatgtctctttcaactgccatactgaggacttttcagccgtggtcccggatgtctggccatacccatcacttgaaaccaactgtgtgataattgattagaaattacagaaactatgaagttgaatctctaacatctttctatatggagtataatgctgggaacatcattattccgtaaatatttttaaaaatgcactggatcaattgtgtatcttttattcctcctgtacaaataaagacctaaactagtaagtata

SEQ ID NO: 404811 - DNA, 457 bp, Homo sapiens
ataggataagactggatggcagaggtcagggaacagcaggtgcccatggggaggtgatctttctcatgtctgaactttttacaataacttcccagtttatctccttgctggtctctcttgttgccacctcttctttatcctgctgtgaatatctatttttctaaaacacatctgggccgggcacggtggctcatgcctgtaatctcatcactttgggaggccaaggcgggaggatcacctgaggtcaggagttcgagaccagccttggcaacatggcgaaaccccatctctactaagaatacaaaattagccaggcttggtggcgggcacctgtaatcccagctacatgggaggctgaggcaggagtattgcttgaacccaggaggcagaggttgcagtgagccgagatggcgccattgcactccagcctgggagacaagagcggaactccgtctca

SEQ ID NO: 404812 - DNA, 384 bp, Homo sapiens
acatcatttttgtgctgtaattgccaaaagtgtgtaacttcagtccaatcatggaaatacatcagacaatcccaaatcgaagaacatttgacaaatagtgatcagtactgtttcaaaatgtcacggttatgaaagataaggaaagactgaggaactgttattgcagtcctacaaaacggcgagagactaagaaataactaaatgcagcgtgatcctgggtggaatttgggaacagaaaaaggacattagtggaaaaagtggtgaaactccaataaggtcttttgtttagcgaatatgttcattttaaattagttaaattatttaaatatatttaaacattatttaaatgtattaaattaataaaattggttattttgtgaaata

SEQ ID NO: 404813 - DNA, 373 bp, Homo sapiens
acagattggccttggtgccagggactgggctggtggtagctctggggttatagcacctgggagaggcagatttcttcctcccagctttactctatcagaatgcaacaaatgggtcatgtgtccttccttgaagcaaacactggctgctgggatggacaatatgattgaccttgccaaggtcatcatgtctcctgtggtcagggaaagtaaggtctgctgatggaaaaacctatctagagcaaatgctttgaaggcacaaacagtccactacagtccaccccttcactccatgatggacacgcaatggacatgcccacatacatctttactcccattaatttgcttataaaaatcttatctaacatgatccact

SEQ ID NO: 404814 - DNA, 185 bp, Homo sapiens
gcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacatgtcattttgggaaaaggaataaaaaatgattgggacac

SEQ ID NO: 404815 - DNA, 486 bp, Homo sapiens
tgtggaggggtatgaaatccctaaggatacaaagggaccttcaggattccccaggcctgcctgatgggtgagtctttttgaaagttgcccctctgtgatttctaggtacatccccactgtgttccccgagtttactctctcacaggtggggctttctgcaaaaccacacagactcaagagctatctggctgtgtgtttctgggggagtgttgtaagtgttaaatgtctgtatgtgtgtgtgtgtgtggcattatgtgtttgtgtgtgtgtgcatgcctgtaagtggagctggcttaaagaaatgtggctaacgcacttcaacacttctttttcatgtgtctaccaatttttttgtaacctatctgtgtggctctgcttgggctgtggggctctgttttttttatttttctgtggattatgaatacgcagtgaattggaaggcttgcagagactcgttggagtccatatcaactcctactgcaaaaa

SEQ ID NO: 404816 - DNA, 434 bp, Homo sapiens
caaggccaggggtataaattaaaagcaaattcaaaaggtctaagtaaaaaaaaaaaaaaatgctaagtagactgtggtagtctcaaaggtatgaggcctcgaagccacagacttgttattaatatttgtcatgaagcagtaaatactctgaaattgcaagcccaaatgtcacacagttatgaatcactgtcaagagtggattatgcagacgagtagtttctttagccatgacattttaagcaaagtaaacattttcgaagtggttgcataacaaactggtggtactatatttttcttaatttcttcctaatatgaggaggcccacagcagaattacaggacaacttgtttgtgtgtgaactagaataattttggcatcatgttataagaactgttccttctacagagtctataaatggaacaggactgttgaag

SEQ ID NO: 404817 - DNA, 313 bp, Homo sapiens
  misc_feature (2)..(2): n is a, c, g, or t
  misc_feature (96)..(96): n is a, c, g, or t
  misc_feature (223)..(223): n is a, c, g, or t
  misc_feature (313)..(313): n is a, c, g, or t
cntaggagtccacagaaaaccttccttcctggccctcccaggtcacctggtgaaatcagaagagacagtcatcctgcaatgttggtcggatgtcangtttgagcacttccttctgcacagagaggggaagtttaacaacactttgcacctcattggagagcaccatgatggggtttccaaggccaacttctccattggtcccatgatgcctgtccttgcaggnacctacagatgcttcggctctttccgtgacgctccctacgagtggtcaaactcgagtgatccactgcttgtttccgtcacaggaaacccn

SEQ ID NO: 404818 - DNA, 478 bp, Homo sapiens
tgtgagcaaacatctcactatcgtgaacgtttggtgcttcgaaacaaatacagaaacttttcataattgttcatgtccttactgggaacagtcctgtctctattaaggctttaccctcagaaccagaatcaaaaaatagttttgtttctcccagctgtctaaccctgcccaatttcttctctcctgtgctgtcctccttcactatttatgctcaggaacccagctgtgccttaaccaagagtgtgtggtgcgcttagcatgctttacacaccacattttctttccacttatatatttctgtcttagtccttcctgccagcttaacaactcaagatggcactggcagttattcccaattaagcactttttacagaaagtgagaggggaaagaaaattacagtctgaaagctatattgttagccacgcccattactaccccttctggctgaaccgacgtaacacctactattgtattttt

SEQ ID NO: 404819 - DNA, 536 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagagtacaatacacgagatgaagcagttaaatagcaaagc

SEQ ID NO: 404820 - DNA, 759 bp, Homo sapiens
gtcttctttctctgggcatttgtagctatgcctcagtgtgtggagtctgctggggaacgctaaaagggctaagatgtcagctattgtaaagcttttttcttgtcttaaaaatggagtttgtgacaactagctagcgctgaatggacttctggttggcttcttggtggaaggaatgtgttatttcaccctggacggagtcatggagtgtccagatcccgcagagaagttttgtgcgagaaaggtcagtcattttggcgtgtggtgtaccatggatgacaatttactgaatggatgggatctatgataaagagtttagcaccctaagcaccagggttttgctctgcccacctctgcctcccaaggagctgtgactacagtttcacagatgaagaaactgaggcttagagagaagacatacaagtaattcaccagggttcatcttacagttagcttgtgaacgctagattcaaatgcagatttttgtattcgtgctagattcaacactgtactcccccaacaacccctcctttttgcctatgctcctctactgtgaaatggctccttggagtaggtaaacttagttactgtatatgatactgtcttttatatctttgctgtaaaagcaaaaatagctgatttgtttaaagaaaccttttcaaggaatcgaatttaatagactgtctctttagattcatttgaaatgtaatgtgcctaaggaactgtgttttccttacactttgacctctctaggataaaatg

SEQ ID NO: 404821 - DNA, 3761 bp, Homo sapiens
gacaaactgcaattcacgtagggaaggaaaggggaaagaaagggacagccaagagatgcaggggcagggggaccccccctctttaatttttcaaagaaaactgctttgtcgttgtgagtttgtgatcaaaagaaacgtgcaatttgcttcagattttacatattctcagtaattatatagttctgtctcatttgaagggttatctaatgattgccttttagaagctttgtatgatctgtcagttctgttcatgttgatgtcggagggatacaatttattcacctcagaaagagatttatttgctttcttctccaggaggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404822 - DNA, 3539 bp, Homo sapiens
  misc_feature (15)..(15): n is a, c, g, or t
  misc_feature (70)..(70): n is a, c, g, or t
  misc_feature (79)..(79): n is a, c, g, or t
  misc_feature (81)..(82): n is a, c, g, or t
tccaggctgtacgcngcgtatgcgatatcgcgaccacgccgtcgctgttctggaattggcagcaattctntgatgtatnannacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404823 - DNA, 3401 bp, Homo sapiens
  misc_feature (72)..(72): n is a, c, g, or t
  misc_feature (81)..(81): n is a, c, g, or t
  misc_feature (83)..(84): n is a, c, g, or t
cacgcgtcgccacgcgtcgcccacgcgtcgcggacgcgtgggtcgacccacgcgtccggggcagcaattctntgatgtatnannacaatgggaaaacggtatatgcaccatccccaaattcagatgatttcaaccgtgaatctcctagttatccatctcctaagccaccaaccagtatgttcgctagcactttctttatgcaagagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404824 - DNA, 4103 bp, Homo sapiens
gattacttgatcatgtgtttatcaaagttgaagcaactttagaccatggcagatggtaacgctggaggtgtagcaagctaggtttctctgccacaagtgctctaatttaattaaaactaaaaacagattagcagaaaatctgtcagtatgccttccttttgtgtgtgtatatatgtatatatgagacaaatctaataatttcttgggttatttttattcagggcatatttatttagcgcttaaaagtgacttgcatttttttaatacctcaaattttgtcttattggtatcctccaccaatgcaaggacttgatggaaattgaaagaggttacttacagcataaaccctccctctgtgctctgtgagttggttcagtcctattttgcataagttccttttgagtagatccatgtgtgaatgcatagtactgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404825 - DNA, 3017 bp, Homo sapiens
tgagaccagacaactggactcatgtcttccaactcaagtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404826 - DNA, 3161 bp, Homo sapiens
ttaataatgaaagattttttaaaatgtgttgggcttataagtagccaatactatgctgaaggccaaacaaaaatattcatgtaaatttatttagttattgagtatctttaccctttccttcacaacattatcaagatcactgagttaacccaggtgtgtggctacttttgggttttaacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404827 - DNA, 2066 bp, Homo sapiens
aggaataccagcatttttttgttggtgggagggggaaggtgttttatttttaacaattatgtactaactggtattgtcctctcccttggctgtccctgccacagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404828 - DNA, 2197 bp, Homo sapiens
gattacttgatcatgtgtttatcaaagttgaagcaactttagaccatggcagatggtaacgctggaggtgtagcaagctaggtttctctgccacaagtgctctaatttaattaaaactaaaaacagattagcagaaaatctgtcagtatgccttccttttgtgtgtgtatatatgtatatatgagacaaatctaataatttcttgggttatttttattcagggcatatttatttagcgcttaaaagtgacttgcatttttttaatacctcaaattttgtcttattggtatcctccaccaatgcaaggacttgatggaaattgaaagaggttacttacagcataaaccctccctctgtgctctgtgagttggttcagtcctattttgcataagttccttttgagtagatccatgtgtgaatgcatagtactgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccaggaggagaggctatgggagcctcaggtaccgagcatctggtgtctggagagatgcag

SEQ ID NO: 404829 - DNA, 1301 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttggtaggctataacacgtgactagggtacagcaacactttgtcctcacttgtgtttctttttggattagaagtgtaaaatctaagtctgccaaaacttctgaagtttgaagtacttcaaggcttaccgcgtttaccatgcctttctaaaaaataaatgacaataagtagtgctctttagctgtaacttgtaaatgctcttt

SEQ ID NO: 404830 - DNA, 745 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggtaagttggtaattctctgcaagtagtcttctcaaagcttctttggtcagagacattttttatccctttgtccaggagggacaggtaagtatctagaagaaagttcttgagtttctaggggcatctagggcttttcttgttca

SEQ ID NO: 404831 - DNA, 686 bp, Homo sapiens
gtattgatgaaagaggaggtacaacatcttggggaacaagtggtcaaccaagtccttcctatgattcatctagagtaagtttgctgatcaacccttgattaaagctgtaatttggcagactacgtaatttctttcatatatgctgtttcttatgagaaatgaaaattaatttcttttcatggaaatgcagtagaatacctagtacctttttgttacatttagttctttttataagctgtcaaactttggaaatttaatttcctacagttaaatattcttggtgttacttgtacacatgaactgcctacagtactctactaaagagcttagaatgcataagtgctctccatatgtatttagccatttttctttatgtgttgtttatttgctttgagagatggcattggctttcaacatactaacttctagcctctctccctcatccttgcttcaacagtcatcagccctttgcatcaggaactcaacagccctgcctcttggaagcatatcaaaacagacataacagatgacatttcttagttaacagttaagagaaaataggaccaagtcaactttctacacactgaggtcacaaggttagagccctttccagcaaaaaacaaaaacaaaaacaaaaaacccccaaagctttataaaatgagaccaggaggtggaaaattagatca

SEQ ID NO: 404832 - DNA, 374 bp, Homo sapiens
tgctgctggaagctcacagacaggtgatgcacttggaaaggctttggcatctgtgagtattgattttacacattctactgaatgaattttacactactgaatacagtgattagattttgtaggtgataagtatctaaagagtatagatgtaacaagatcaatttcattacacatttagagttattctcggtttgtattgatatatgcccttaaatgctatgcctgtggtacagcaaatgctgggaagaggaaaaagaagtcatctaaagcaccaactgccaagattaatcattaaatctatttcttctaaatacatagttagtaagtggtccattaaaataagtcaagtggaaccacgaaagataactcagtat

SEQ ID NO: 404833 - DNA, 272 bp, Homo sapiens
ctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagaggtaagtaggttcagccgagatgtataactgttctgcttcagatgggcagacatttctgtttacagttg

SEQ ID NO: 404834 - DNA, 4299 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404835 - DNA, 4031 bp, Homo sapiens
gattacttgatcatgtgtttatcaaagttgaagcaactttagaccatggcagatggtaacgctggaggtgtagcaagctaggtttctctgccacaagtgctctaatttaattaaaactaaaaacagattagcagaaaatctgtcagtatgccttccttttgtgtgtgtatatatgtatatatgagacaaatctaataatttcttgggttatttttattcagggcatatttatttagcgcttaaaagtgacttgcatttttttaatacctcaaattttgtcttattggtatcctccaccaatgcaaggacttgatggaaattgaaagaggttacttacagcataaaccctccctctgtgctctgtgagttggttcagtcctattttgcataagttccttttgagtagatccatgtgtgaatgcatagtactgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404836 - DNA, 3915 bp, Homo sapiens
gtcttctttctctgggcatttgtagctatgcctcagtgtgtggagtctgctggggaacgctaaaagggctaagatgtcagctattgtaaagcttttttcttgtcttaaaaatggagtttgtgacaactagctagcgctgaatggacttctggttggcttcttggtggaaggaatgtgttatttcaccctggacggagtcatggagtgtccagatcccggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaattcttgaattctaaatattactctttctagatt

SEQ ID NO: 404837 - DNA, 1370 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattttcctgaccataccagctgtacatttggaaaaataaaactttattaaatca

SEQ ID NO: 404838 - DNA, 760 bp, Homo sapiens
cgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatggatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccacc

SEQ ID NO: 404839 - DNA, 560 bp, Homo sapiens
aatactgcaaaaggagaaacaagtcgattaaattttaagaagtgtaaatacaccaaaggtgagaattattcactggtgtaacttaggaatcaagttgaattacacagatagagaggacctttaaaacatcaggttaaattgagaatattctagagcagaaataaaattgacagaattctagaatagaatacaggtaacaatatctgcgtttgttaatttaaaagagagatagaggttttggtttttcctcatctaaaagagaggtctgcatctctgaaggaataataaacttggcatgatacttgcatggacactgagcagccaaaacaagatggctctagggactaaggtggacagtattgtatacttttggctggtgcatttagacatctctcaaattttcaaatgccatcttgagacaatgcagttacattttatttaatgcaattgcattaaataaaaagagacatttaaaaaatgttatatgaggtgatgctcacaaagcaaaagttttgagatctttaaaaacttaaagtataaaggggtctggaaactaagaa

SEQ ID NO: 404840 - DNA, 401 bp, Homo sapiens
accactagacctcccactggactgcggctacagccgcctccctgcagccaaagagctctgacatccagatctcaccccatcaatctcccttcaaacatcaaccacaagaccagatccgagttttctgcagacacaccctcagtgaccacagccttccacactagtccacaaccaggaaaaagtggcagtcttgggaactgctaacccaggatccctagtgcaccttcacaaccctttctgatctggcttctttgacgctgggttcctgggtgtgccttggctctagtccagcaggcctcagccagactggtcctaccaggatacctctgacgtctctgcctggtgaactcctacccagccttcaaaactcagccctcatattacctcctccatgaagcctt

SEQ ID NO: 404841 - DNA, 450 bp, Homo sapiens
tttttctctcttgcctcatggccctttctttcttccatctgcaaagcaagaaacatgacgctgattccttttctgctgtctctctggttctctcgctctgcctcctccttccatttttaaggacccttatgattacactgggcttatcgggataatccaggataatcttcctatcttaaactgattagcaactttaattcatctgcaaccttaattcccctttgccatataaggtcacatattcgcaggttccagggattagaacatggacctctttggggggctactatttgcctagcacactacccaaactttgactcctactcttcagggtaatgctgttccatagagaatcagatacaatccatcttaaaatgtataccggcagcccaaatccatcccttctcccatttctcatccagcatacaggtgaagaaacaatatggcaga

SEQ ID NO: 404842 - DNA, 474 bp, Homo sapiens
accctgaccaagaggaatcctttgagggtctgcagtatggaaagaaattctctgaggcgctaaataaaatcctgctctgaggtgcaaggaggacttttttgaaattaatagctaacaaagtttatgcagaccccaaaaggaaaaacagaaaggaattggaatcattttaaaaacagagtcggtagataataaaacttcacggtggtggtgttgtctttcatcaagaagcacgaagtgctcacaggctttaattacatcttcatccctacggccccttctgaagtcggtagatgcacgttaatagtacctttcgttttaggcatggacacattccggtaccagaagctttagcaattctccccaaggcaagcagagtacagagctggatcggggcgcaatgactctccaggccagcatcccatgctacctccagttgtatttcctgactccgcagctgaaaccaaggacttcatt

SEQ ID NO: 404843 - DNA, 779 bp, Homo sapiens
gcccctctccccctttccctcctcccagcgcttgggggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404844 - DNA, 648 bp, Homo sapiens
ggaagacctttgtgagtgtccaggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404845 - DNA, 1043 bp, Homo sapiens
  misc_feature (969)..(969): n is a, c, g, or t
gacgcccggagactggcgggccgagggtcggcgtcaggctcaagcccctgccggcgcccttggatctgtcctgggccccagaggcggcggggcggggtccgggcttcgcggccgtcgcccccacccctctcctgcgggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaaaaaaaaacacnaaaacaacagacaaacaaaagagggcgaagcgaaaaagaggaccccagagaggggccaaaggaaacgagcaaca

SEQ ID NO: 404846 - DNA, 896 bp, Homo sapiens
  misc_feature (711)..(711): n is a, c, g, or t
  misc_feature (774)..(774): n is a, c, g, or t
  misc_feature (808)..(808): n is a, c, g, or t
  misc_feature (824)..(824): n is a, c, g, or t
gcgggtttccgggtgggaggggccgggaatcggggccgtgaagggaagccctcgagggccggccgggagcccggaaaccgaggtcccccttcggccagttttaatccccccgccctcccctctgccccagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggaganggaaggggctggttgttgggaaaaaaaaattggggggggctgggcttgaaaggaaaaaaaatnttgccttggggttgggtaaaccttgccaaccaanccccctttggggaaantttggcttttttggttccaaaaggtttttttggggggaaaatttggttctttttggcccttggccttgccct

SEQ ID NO: 404847 - DNA, 870 bp, Homo sapiens
ggaagacctttgtgagtgtccaggaccggctgtgccaaaacgggcccctgtaatgcatagactccaaacttgacttctgtcctttgctcctgcagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaaacaaaacaacagacaaaacaacaaaaaccccagagcacataatcccggggagcgggcaaaaacgcggcacagaactggccccacggggcacacacagggaaccctgaacccacaggacgcgctggcaacaacaaggggaaaaactcaggccggaacacccatgttgcaggaaagcgcagaaaaaatcagaaaatacacccggcgaaacacgcgaataaga

SEQ ID NO: 404848 - DNA, 588 bp, Homo sapiens
gcgggtttccgggtgggaggggccgggaatcggggccgtgaagggaagccctcgagggccggccgggagcccggaaaccgaggtcccccttcggccagttttaatccccccgccctcccctctgccccagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcacaggttactagcaacttcccggcagcaaaggggaatacccgaataccacccacactgcttaaccctggacagaagcacgccgatcttcgcgcccccggctgctaccc

SEQ ID NO: 404849 - DNA, 266 bp, Homo sapiens
gggacacatcactcttgctcccttttcctcttcccttctcctggcctaactggccagaggaacccggtctcagtcacagctgatgcgcgcgtgggatgtgcactggaggatagtgaggggggcagttctgggagagaattgagctgggagccctggaggcctgtagaaagcattattctaggtcagaaatacgtgtcttgaggtcaaggctttctgggaggtttttgaatttggtcatgtccctgattaaagagccgggaggggat

SEQ ID NO: 404850 - DNA, 958 bp, Homo sapiens
agccagcatgctgcccccttggcggcggctcggcgcccccggaaaaaatttttcccggttggccccaacccgggcaagggcggaggagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404851 - DNA, 947 bp, Homo sapiens
tccctggtgtgtctagtggttaggattcggcgctctcaccgccgcggcccgggttcgattcccggtcagggaacgagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404852 - DNA, 1160 bp, Homo sapiens
  misc_feature (1086)..(1086): n is a, c, g, or t
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaaaaaaaaacacnaaaacaacagacaaacaaaagagggcgaagcgaaaaagaggaccccagagaggggccaaaggaaacgagcaaca

SEQ ID NO: 404853 - DNA, 1208 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaaaaaaaaaaaaaaaaaaaaaaaaattttttggggccgccctggccccgaagaaaagtttttaaacacaactcgggttggggccgccggcccaaagtcaaggacaacgggccaacaggcgggccaaaggaaaccg

SEQ ID NO: 404854 - DNA, 1245 bp, Homo sapiens
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404855 - DNA, 950 bp, Homo sapiens
gcgggtttccgggtgggaggggccgggaatcggggccgtgaagggaagccctcgagggccggccgggagcccggaaaccgaggtcccccttcggccagttttaatccccccgccctcccctctgccccagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404856 - DNA, 891 bp, Homo sapiens
ttaggtcagacgagccggtgttaatcggacgaggcggagccgggggtaaggaacgcgcaccagcctgggaaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404857 - DNA, 917 bp, Homo sapiens
cggtatggagggggatagatgttggaaggagtcatgagatgttggaaggaggcatgagatgtaggaagccttccaacatctcatatctccttcaacttgcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404858 - DNA, 799 bp, Homo sapiens
  misc_feature (28)..(28): n is a, c, g, or t
  misc_feature (54)..(55): n is a, c, g, or t
gctcgcacccatagctgacaccgacctngctctacgtcctcctgctggcccttnngcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404859 - DNA, 809 bp, Homo sapiens
cattgcctcatctcatgcctcatccagtggcaagcctgtggggcaaggtgaatgtggaagatgctggaggagaaaccctgggaaggctcctggttgtctacccatggacccagaggcttgccactggatgagggcatgagatgagggcatgccactggatgagggcatgcacatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404860 - DNA, 536 bp, Homo sapiens
gatgacaccatccctacagcagacgcgcagcattgcaggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404861 - DNA, 1026 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacctttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404862 - DNA, 880 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggaggctgtgtggagaagattggtcgacgcggccgcgaatttagtagtagta

SEQ ID NO: 404863 - DNA, 966 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattaccaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404864 - DNA, 1510 bp, Homo sapiens
atgggcggtctgggactgccagagcagcttggttcgggctcaggaagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404865 - DNA, 417 bp, Homo sapiens
acaaccttcttctccatatttcttccctcccccagtttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404866 - DNA, 880 bp, Homo sapiens
  misc_feature (727)..(727): n is a, c, g, or t
  misc_feature (762)..(762): n is a, c, g, or t
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagatggngaggctgtggattaattcacgagaagcgatcatangaggcctgttgagagatggggctgctgagaaatgtctgtgtactgacaccctggaatgctttgcagttttgaatgcttgctgtgctctgaaattatagtgctcaaggattagggctgt

SEQ ID NO: 404867 - DNA, 1012 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatgagaaaatcccttccatgtcgaagaaccgagtccccgactcctgctgcattaatgttactgtggaggtacagcgccttccttttccacctgagctcttcctcctacacatcacagtagcgaccacagctccgatgaccacaactgctaggacagccaggccagcaacaatgcccacggctctgatgtgtctctcacagcttgaaaagcctgagacagctgtcttgtgagggactgagatgtaggatttcttcactcctcccctttgtgacttcaagagcctctggcatctctttctgcaaaggcgctgtagtagggtaccg

SEQ ID NO: 404868 - DNA, 916 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacc

SEQ ID NO: 404869 - DNA, 839 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattaccgagccacccaaagagccacccagctcctggggtggctcgtcgggtggcccttcgtgtggctcttggcgtggctctttgtgggcacatcgcgtggctcctggggtttatcgtgtgagcacaccatatatttacagtaggaatagacgtagacacacgagcatatttcacctccgctaccataatcatcgctatccc

SEQ ID NO: 404870 - DNA, 1486 bp, Homo sapiens
  misc_feature (13)..(13): n is a, c, g, or t
  misc_feature (28)..(28): n is a, c, g, or t
  misc_feature (47)..(47): n is a, c, g, or t
  misc_feature (60)..(60): n is a, c, g, or t
cgaccatatcagngggctaccctggctntctgtgccgggcctcaagnagactatttgtcntatgatcacgtttgccatctttctgtctcttatcatgttggtggaggtggccgcagccattgctggctatgtgtttagagataaggtgatgtcagagtttaataacaacttccggcagcagatggagaattacctttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404871 - DNA, 615 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtaagcagggaataatggga

SEQ ID NO: 404872 - DNA, 294 bp, Homo sapiens
gcgactctagcggatccttcagacagcggaccccagaaggcgatccataaggaggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404873 - DNA, 1251 bp, Homo sapiens
ctcccctgcgcggagctgtgagccctggaacaccgtggtctgcttctcaggacgcgcaaacagtgaagccagtcccgcccggagttcttcatatattaaggattcattcattcatagactcatttattgaaggctgtctgtgtaacaggcacaatcctaggtgcttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404874 - DNA, 1073 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404875 - DNA, 600 bp, Homo sapiens
atgggcggtctgggactgccagagcagcttggttcgggctcaggaagtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404876 - DNA, 531 bp, Homo sapiens
ttgatccccctccatgatgtgtgcccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404877 - DNA, 730 bp, Homo sapiens
gggacacatcactcttgctcccttttcctcttcccttctcctggcctaactggccagaggaacccggtctcagtcacagctgatgcgcgcgtgggatgtgcactggaggatagtgaggggggcagttctgggagagaattgagctgggagccctggaggcctgtagaaagcattattctaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggaggctgtgtggagaagattggtcgacgcggccgcgaatttagtagtagta

SEQ ID NO: 404878 - DNA, 1025 bp, Homo sapiens
  misc_feature (953)..(953): n is a, c, g, or t
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataagtgatgtcagagtttatacacttcgggagggaaggggataccgaaaaaacagatgttcgatctggaagctgcgggatttaggtgggggtgtactaacgatggaaaatcttcggtgaaacggtccgactggctagtagggggggtataccggagggcaaggggggtgaatggggtggaagttgggtcnctttattgagtgatttgcaaaaagaagtggggcgccccggggcctaaaagttgtttgcttttttttttccct

SEQ ID NO: 404879 - DNA, 642 bp, Homo sapiens
  misc_feature (28)..(28): n is a, c, g, or t
  misc_feature (54)..(55): n is a, c, g, or t
gctcgcacccatagctgacaccgacctngctctacgtcctcctgctggcccttnngcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagatgtgagtggggttgctgggagcaggggtggtgggaatagagaattctcatctccaaggctgggtgtggtgactcacgcctgtaatctcagcacttttgaaggccgaggtgggcagatcacctgaggtcagaagttcaagactagcctggccaacgtggtgaaaccctgtctctactaaaaatacaaaaattagccaggtgtggtggtgagtgcctgtaatcccacc

SEQ ID NO: 404880 - DNA, 1983 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404881 - DNA, 1254 bp, Homo sapiens
  misc_feature (1079)..(1079): n is a, c, g, or t
  misc_feature (1081)..(1081): n is a, c, g, or t
  misc_feature (1083)..(1084): n is a, c, g, or t
  misc_feature (1091)..(1091): n is a, c, g, or t
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaaaacaancnannacaacanacacaaacaaacagacaaaaaaggcgcgcgccaagagtaacccgacgcgcaacacgaccacccgcgtgcagaccagcagcacacagaagcaaaaaaaaaagggtcgcaaaagacggaacagaaccagtagcatagcagcccagtgcgacgcgaccagcaaagg

SEQ ID NO: 404882 - DNA, 1511 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404883 - DNA, 956 bp, Homo sapiens
gacgcccggagactggcgggccgagggtcggcgtcaggctcaagcccctgccggcgcccttggatctgtcctgggccccagaggcggcggggcggggtccgggcttcgcggccgtcgcccccacccctctcctgcgggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404884 - DNA, 961 bp, Homo sapiens
cccggcggacttcggcgcgggctgggagagaccacccgcagtcccttcctccagggctcgccccaggcccgcggagactcgtccggcgctctccagccgccctggagcaactttgcttcgaagttccctgggcccgggcagggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404885 - DNA, 923 bp, Homo sapiens
gggacacatcactcttgctcccttttcctcttcccttctcctggcctaactggccagaggaacccggtctcagtcacagctgatgcgcgcgtgggatgtgcactggaggatagtgaggggggcagttctgggagagaattgagctgggagccctggaggcctgtagaaagcattattctaggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404886 - DNA, 1000 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtacttcgggccctgcaggggaactatgtcttatgtcacgttgcatctttcttctctatcatgttgtggagtgccgcaccatgctgctatgtgtttagagatagtatgtcagagttatcatcaccaccg

SEQ ID NO: 404887 - DNA, 1899 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttggggggtgtttgggaaaggaggactttgcgaaggtgttggttgggcaggcagtgggagaagtgaggatccagagactgtggtgctttctgccccctagtcttatgctgccaggctcactatgaacattcatgaagccatctgctgcataagtcaaagcagctccccagaaaggtcccacctgcgagagcccagcccccatctgccttggacatcttcctggccttctgtgcaccgctaagggcccagcacctcccttcctggccaatcctcaagggatccagctcctttcgaagtatgataagttgccttgacacctgtgtggtcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaatctcttg

SEQ ID NO: 404888 - DNA, 914 bp, Homo sapiens
  misc_feature (855)..(855): n is a, c, g, or t
  misc_feature (891)..(891): n is a, c, g, or t
  misc_feature (893)..(893): n is a, c, g, or t
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggaggctgtgtggagaagtctggcacnacttcgtccaccgtgacctctcggactcgcggcgtntnggttctcgcgtgtcaggtacc

SEQ ID NO: 404889 - DNA, 1009 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404890 - DNA, 956 bp, Homo sapiens
gtggcttcggggaagggcttcctccccttttctcagactaggatccctggaaaatggagaagctgtgctaatagaggggggccagaaatccccactctagaatgctgtagaatgttgggagacacccaggatctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattaccaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404891 - DNA, 829 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactaggcaagtccaaaatccacagggcagtcctcaggaagggtgggccagaactcttagacacagactgaagcccctggcaatgggtggaatttctccccctcccagggtcgacgc

SEQ ID NO: 404892 - DNA, 801 bp, Homo sapiens
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattaccgttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404893 - DNA, 649 bp, Homo sapiens
  misc_feature (648)..(648): n is a, c, g, or t
ttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggcgatgcccccacttcctccccccttccggccccccatggcgcattccccccnc

SEQ ID NO: 404894 - DNA, 325 bp, Homo sapiens
cagggaagagacagaggcacaaggagggggttggggtgggaagtttctgatggtgcttttgtcctttgtgcctgccaccttcagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaa

SEQ ID NO: 404895 - DNA, 218 bp, Homo sapiens
  misc_feature (6)..(6): n is a, c, g, or t
  misc_feature (42)..(42): n is a, c, g, or t
tggtancgtttgggaagcggtttccctctgtctaccaccaanatttggagtcatcagtattcctgaacttgaactctaccgtaaacaatgtaatgccaggaagaagtaccgaatgtcagctagaaaccggtgcagagggaaaagagtcaggcagagctgatggatccagtttgaaaaaacaaaatgccattcaacggtaaaaaaaaaaaataataaaa

SEQ ID NO: 404896 - DNA, 741 bp, Homo sapiens
ctctagcggagacagaaaaattcgctgcaagtacagcactttctagattgctcctggagtgtgggaacaacagtctctcctgtccacgttactgaatccagaaaaaaggtgaacttacgaacatgggaaaagaaatccagctaaagcctaaggcaaatgtctcttcttacgttcactttttgctgaattacagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggcacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaacggtaaaaaaaaaaaataataaaa

SEQ ID NO: 404897 - DNA, 712 bp, Homo sapiens
ctctagcggagacagaaaaattcgctgcaagtacagcactttctagattgctcctggagtgtgggaacaacagtctctcctgtccacgttactgaatccagaaaaaagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccaggaagaaatgatgaattatgttggcaagaggaagaaacggagaaagcgggatccccaggcacccagacggcctccatcatccttcctactcttctgccaagaccactatgctcagctgaagagggagaacccgaactggtcggtggtgcaggtggccaaggccacagggaagatgtggtcaacagcgacagacctggagaagcacccttatgagcaaagagtggctctcctgagagctaagtacttcgaggaacttgaactctaccgtaaacaatgtaatgccaggaagaagtaccgaatgtcagctagaaaccggtgcagagggaaaagagtcaggcagagctgatggatccagtttgaaaaaacaaaatgccattcaacgaaaaaaaaaaaaaaacacaaaaacaaaaaagacaaaaaagaccacagaccaaccaggaaacaaaaacaagaacaaaag

SEQ ID NO: 404898 - DNA, 522 bp, Homo sapiens
ataatacaagcgtggtctggttgatgggtatttttagatggttcttatgtctatagtaggaggcttaacattttagcagaatctgaacatctgagcatttagcctaaggcagttaactcctacaaagtgtccatgaaacaaatacatctgaaaaggcctatgctccaatgcagatctgtaatccatgagcagttttggagtacagatcagattaatgaagatactttaacaacatgccacctaatctgatgttaatagttaacgttacccctgaattggcaggaattgtcaaaggaaatagagatgcaagcttacatcaaatttaaaagtatggcaggatgattatgtagataatgtgttaagtggttttcacagacaaattaactatgcacagttatatattaacataatgccactgtattttagtaaaaatataagggaaaccaagtcctgaaaaataaccaggctaacttttactaccttccagttttgtcgacgcggcccgcgaatttagtagtagta

SEQ ID NO: 404899 - DNA, 451 bp, Homo sapiens
ggcaacataggtgaaccttgtctctaccaaaaatgcaaaaattagccaggcgtggtgatgcacgtctgtaatcccagcactttgggaggccgagtcgggcagatcacaaggtcaggagatcgagaccatcctggccaacatggtgaaaccccgtctctagtaaaatacaaaaaaaattagctgagcatggtggtgcgcgcctgtagtcccagctactcaggaggctgaagcaggggaatcgcttgaacccgggaggtagagattgcagtgagccgagatcgcaccactgctctccaggctggcgacagggcaagactccgtctcaacaacaacaaaaaaagaagtgttgagtaaccagtgagctgacaagcccaccacgtggaggactcgggtaggagacttgggcttgggggagtggatcgcattctatgatgacagagctagctggggg

SEQ ID NO: 404900 - DNA, 621 bp, Homo sapiens
ggcaacataggtgaaccttgtctctaccaaaaatgcaaaaattagccaggcgtggtgatgcacgtctgtaatcccagcactttgggaggccgagtcgggcagatcacaaggtcaggagatcgagaccatcctggccaacatggtgaaaccccgtctctagtaaaatacaaaaaaaattagctgagcatggtggtgcgcgcctgtagtcccagctactcaggaggctgaagcaggggaatcgcttgaacccgggaggtagagattgcagtgagccgagatcgcaccactgctctccaggctggcgacagggcaagactccgtctcaacaacaacaaaaaaagaagtgttgagtaaccagtgagctgacaagcccaccacgtggaggactcgggctgtgagaagctcggcaggaaggcgggagaggccccaccttcagaggcgcagctcagaaggcttgagagctccccgtgaaagggatccctgcagtgcagaaactgtctctgttacctgcattgctctgaacaaaaccgacccagagcagtttcagtgatggtgataatctcaagcaatgccattaccaaatcttaatgccctgatcctggccacctttgaggaggtaag

SEQ ID NO: 404901 - DNA, 388 bp, Homo sapiens
gagggtcggagagggaaggaagggagaaaaacagaggggggagagggaataactgactccttcaggaagcgctcttgaattttagctcaaaagacacttagcaatttgcagtagttacctgttactccataataaattaccccaaaatattagttgagtgtggtggtgcacacttgtagtcctagctactcaggaggctgaggtgggagcattgcttcaggaggctgagctgcagtgagctatgatcatgccactgcactctgacctgggcaacagagtgagatcctatttctataaaaataaataaataaatcaccctaaaacttagtggcttcaagcaataaacatttattttctgtccatttctgtgggtcaggaattctggagt

SEQ ID NO: 404902 - DNA, 486 bp, Homo sapiens
tgtcctcttttcccttgtcatcttcaacatagacttaactcccttaaacccaaactctgttgggccctgaccctccagtaattggttaccagtgtgtcaggcaatcagactttccagtggtgccactgagatggagccccccaaaaagagtagagtttccatttctagattgtggattttcagattttcagataaattctgccatttttatttcatttcctggaagtcagggtcagttcatgaaaagctgttaaacaatatgctaaagttgaaatgtcaaccctcactctaaactctccctgttcagggcataaaatgaagacctcactgggttttatagtggctttccgattttgctagtccattgaagaagggagtttgaaagttgttgtacaccgttaacgattatctgcccatgtcctgcctgaaataccctgattgtttatggaaagtaactttaataaagctagatatagtttggcttgg

SEQ ID NO: 404903 - DNA, 479 bp, Homo sapiens
gcaccgtcaagactgtgtattgcagcggctgtcaggaaaccaagtatgcctccgggagggttaagatcaaagatgaagctggaaatgtcgtcctggacgagaagcagatgagccctcaacacgcagcatcacatgggaaatgccaattgcagatttttgctaaaacagacaaaaactaataacatattagctgccctaaatgatcttggagagccaccaaaactttaggactacccaagtcatctagaaattgcaaaggaaaagacattctctcccctatttaggaaacttggttagagcagcacacgtcagagaacagaaggctcacaaaagaacgatttcttgtcttctgctagcttttgaatattttgctcttgcttctctagttcttttaattgtgatgttagggtgtcaattttagatccttcctgctttctgatgtgggcatttagtattataaatttttctcataacactgc

SEQ ID NO: 404904 - DNA, 416 bp, Homo sapiens
ctaaggctcaggtctgcctcttgggtgagcagcgactacgtgagactggtattacatgggtgggaaaataatttatcaacagttttaggtaaagaaatgcagatttattagagaaggtatgaaaatacgttgaaaggttgcaatgggcagaccagccagagaggagctgacttcaaggaaacaaaggcttgctggagattttatccgatggttcttgggctgcagagtgctgtgcagtaccgagaactccaaggttacagggagctaacttgcatgtgtctcgtgatagctgagtgcaggaagattgtgagttatttgcacaggagggctacgtgtcctgcaccatgaagaaaggcagacttagagtgcatctgctcttcttgctatcccttggtcccactagcctgactcccttt

SEQ ID NO: 404905 - DNA, 446 bp, Homo sapiens
gtctacttctaaataaaactattactacatcttcattgccacagtccttcagattttgtttactggtagctgttggagatattctgacttcctgtaaatagaattccaagtattctgagagacaaaatagaatgaaagtgcactgctaaagatgtggatttatttccttaacacattaaattcatagtcagcagtaatgtatatccaggtgttttatctcaaacacaatatggcaaatatttaaacgccttccaatttttgaaaatttctccttttcataaggtttgttagattattttggccttcagaattccctatttcatggtacctggtcaaaaatgtcatagccattcattgaacatacatatactgagcatcagttgtatgtcagatagtgtcctaggaacaaaaataaataagaaaaaactctgtcactcaaggtgttc

SEQ ID NO: 404906 - DNA, 335 bp, Homo sapiens
gtcttgctctgttatctaggctagagtgcaatggcacaatctcagctcactgcaacttctgcctcccaggttcaagtgactctcctacctcagcttcctaagtagctgggattacaggcatgtgccaccacaccctgctaatttttgtaattttagtagagactggggtctcaccatgttggctaagctggtctagaacttctgacctcaaatggtccacccccatcggcctcccaaagtgctgggattacaggcatgagccaccatgcccggccccagctataagggttctttctatgaaaacctaagataaatactctggaaaggtgaggtgc

SEQ ID NO: 404907 - DNA, 561 bp, Homo sapiens
atttaaggtgggtttgtttttgtctttgtgttttattttttgtgtcagctcaaagcacttaatgtaagaaaatactagaagaaagaagtactggaagaaaacggccacactggagtggaaggttctttctaagcatgacctagaagccgtcattagagagttggccaagacctgattaataaatttgaccaaattaaaaactcgctacaaaaaaaaaaaaaaaaaaaaaggaaaagaaattttctgacttatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagttttcccctgggtccttgggtcttcatttctgaaggctcccatgtcacctaaaactttgattaaataaatgtattatgcttttctcttgttaa

SEQ ID NO: 404908 - DNA, 506 bp, Homo sapiens
aggggcagtgtcccgcaggcagtgaactggcacagcacccctgcccctgaccctcgccattgccattgtgatgggggaggggtcagggcccctctgcacagtccaagccacagcaaaatctgggaagtctcctggtctttgcccaggaaacagccttcctagacaggctctgaattattcacctcttccccttcatattacaactgccactcagacgtgaaggtgcagcacaaagcttcagaaacaatggaagaaactgaaatcaggatcctgactcctgcatgggaaagctatagctgtgtgactttgtgcaaatcacacacctgttctgtgtcttgcgtctgcatctgtgaaatgcaggtgaacctagcacttacctttgagggctccttggagaattaaatgaattaattcatacaaaggacttagagagatgtccggcactgagtaaacactcagtgctagctgttatgatgatgattaaagataatcaaagcttaaaaaaa

SEQ ID NO: 404909 - DNA, 443 bp, Homo sapiens
ggatcttaaaatttattcacaatgttttcatgttttatattaggaattatctggttctacagaagtagagaattccattcctacgggaatatcagaaggaggttaaagtgggcacaggtaaatcatccatttggctatcaaaaagtctgattctgaccaggcgcagtggctcacgcctataatcccaccactttgacaggccgaggcgggcagatgacctgatgtcaggagtcgagaccagcctggccaagatggtgaagccccgtctctactaaaaatacaaaaattagctgggcgtggaggcgggcacctgtaatcccagctacttgggaggctgaggcaggagaatcacttgaatccgggaggcggaggttgcagtgagaggagattgagccactgcactccagcccgggcgacagagtgagactccgtctcaaaaaaaa

SEQ ID NO: 404910 - DNA, 545 bp, Homo sapiens
tgagacaaggtctcattctgtagcctaggctggagtgcagtagtgctagcatgaggcttactgcagcctggacctcctgggctcaaacaattctcccactgtagcttcccacgtagctgagagtacaggtgcacaccaccacacttggctaatttttatgtgttcggtagagatgagttttcgccatgttgccggggccagtcacaaactcctgagctcaaaagatccactcgccttggcctcccaaagtgctgggattacagcagtgaaccacctcacccagcccacagtttgcatttctaacaagttcccaggtgatgctaatgctgctggtctgggggtagggaaagggaatgggaagcacgccttgataactaatgatctagacctgcttttccattatggtggtcactagccaaatgtggttactaatcacttcaaaggcgggtagggagactagggaactgaattttttatattatttcattttaattaatttaaacaccatgcacggtctagagatcattcagagacaaggctctaat

SEQ ID NO: 404911 - DNA, 344 bp, Homo sapiens
actttacagtttacattagactctcctccccgacgtcatttgcacctcccaaggccagttctcccggtggtttccagccctggggcgtttgtggttctctctgcctagtgggatgcaactggcatttagtgtttgtccgtatgtgggtgtggctggggagggcagagaggcaaacagccccgcacaagctgtacagtccccctcatcaagatgtggcactccctctttgccaatagcaactcctttttgaaacactgggcctgaagcaatcatcttgaagacatttttcatcaatcttgttgaaatcaacctggtttttcaaaatagaggaagcacatcaatga

SEQ ID NO: 404912 - DNA, 335 bp, Homo sapiens
aaatgctgcctgtgcccaaagcccccttccgcggacttctaagattaggagcaaactcaggggtaggggctgggggtgcagggagaggggatctgaaccacctgtccgcaagcaatagtcctattttgggctggtggcttctgagaggtgactcattgtggactcaggatgaccaagacaaagcaactctggctgattccagccaggaggattgaggcctgtgagttatacctgtggttgaaaaccgaagcttcccttgcccctgctccctccagtagtggccccttggggctatttgtgtcagaatattgaatgtgcgtgtgtgtgtgcgtgtg

SEQ ID NO: 404913 - DNA, 466 bp, Homo sapiens
aaggcaggagaatcgcttgaacccaggaggcagaggttgcagtgaggtgaggttggcaccattgcactgtagcctgggcaaaaagagcaaaactccatctcaaaataaataaataaataaaatgttcagtactcaccaaggtgcccctgttgtctctacttttatcttgatgcatcactgaattgatgttagatttcaaattcatcattgccctgatactattctatcctgaagccacctttatatagtgatgaaagaaattagcgatttgttattatcctctctctgttggtatacatcaaatactcacctaaaaaagagcaacaaccagtggaaaacatgatgtttttatttgggtgactatttacttgtaacctactagcaaactataaaattgtatgatatgcagaattttaactgaattgctttaagtgaacatttaaacatgataaacaatattgatggt

SEQ ID NO: 404914 - DNA, 2088 bp, Homo sapiens
ttttgtgatttacgttaaacagtttcagcattgagagtgagatgcttaagaattttaatttcatgtgagtgtgcagaaattataagaaactattaatttagagctggtcaccaaatgaaattttagaaccttcagtgctgctctttagtattttccatctcctacctttacactggaaatgaattttttaacttcgatctacaaaagtgcataaaaattcctctgtccatagagtttattttagatatttctctatgagtgactatacactagaatgtacatttgtatagaaaaagtaatttatataacttagaagaaagtcgtttttataacttatctatctctctctggtttttatttgtgtcacttctgcattgcccagtattttgagttgggggaaaaatgaactcacctggccccacctcctgttccagtgtgaaatactgacacttgctgccagcccagcctcctcacataagcattagaaatatcagacagtccactaggttagagcacctcattcatgaggttctgttatttattcggctctcccactaaaatgcagggcataaatttatgtgtctgctctaagactgcagctgtctgccccccctccaccctcctcctgcccttcctgtgtcagtgttacattcgctccccccacttttggtctcaggtctgtctcctttttgtttttatgggtgatttgcagtgattcagacagggcatccttgcatgttggcacttcctggaggttaccaggaggcagccatccttccttggcttggccaggcatccccgactccaccccactttccccttggtggtggaaaggtgggttggaggtgtgtactggggcacatagcccaggaatgttgctctgagaagaggacatgtgcagtagacacaaaaatataaggaagcaattatgttcatcaagccgaaagttgcagattttgaggaaatgtgtttaagataccactacataataaaagggaaaaccacttggcatttaaataacttacttcaagaggaaattatgatattttcagtctacaaatagagtggtttttaagccaaccttgagtaggtacaagcaaattataaacagtctgctcaaatgattttactatacttagactagaaaatggctcctcttctctctccctctggtccctatgtcccagtgctgtccctcatatgttacaattgttcgtgtatgtattttagaatattcacaggtaaatgatgcaaataatatatatataatgttaaatcatcctcaaactgggtgtatatgactttaggtaaaacagttccttactttaattgtctgttgaaagctttctgatctttctgataatactatacattttagtatatgtggcattgcttttgagggggggaatagccattttaacaaaaaaacttgtcacctatacctactatatagggcattttgctatgctgtatattgaaggctatattgtaatgatagaaactttcttaagtttgtatgacttctagaaagctgctttcagagtgaaaatctcctaggtcatttgttgaaaggttacttagactggatgtgtaatgttttttcttacatctcatgattgaaaccatgggaattgtgattcagagagaagtactgaaagtgaatgtctataaggtatcatctgagaagggttctggaatttagggttttgttgttgttacagagatgggatcttgatacgttgttcaggctggtctccaactcctggtctcaagtgagcctcgcatagctaaaagtggtgaagcttggacatgaatactggcccttcacttctctgctatcctgcctctcatagtctgcctctctcatagtaaataaatacagattatacttattatcaggccaaaattgtgaccacagtgtgggacattgggacttggttgcattgctctaaccagcaagaagcttgggtatcagctttgagaattattcccttctgtgtcacctcttgaatcaaatgtgtaccagtggtgcagcctccctaaacggatacagtatttcttcattctgcttacatatgactctttaaa

SEQ ID NO: 404915 - DNA, 393 bp, Homo sapiens
tagccctggacctgtctctgatcctgagagctgggccctctgcagctgagaacgtgccctgcagccgctttccctccttagccgtcgtgcacaacctgtgctgtgagacgctgctgcttgcctggcactgctgttgaatcagtctccatctcctcattttgatggcagcctgggtttgttatccttcaaagatcgtctcttggaaggacaccagcctctgattacatttccgagcctgcctggaggcagctaagctaatccgacacgatttgggtggattcccttctggcctcatgttctgacacaacctctggcagcagtagggtgggaagatggacaaaataattacgccctatgagttgaaaggagaattaaaattaattccctcgtgca

SEQ ID NO: 404916 - DNA, 649 bp, Homo sapiens
cttcctctctgcattcttttgcatgcccaccttatctaaaaaaatcaaatgtttagccaaccaggattagttcagattgtacgacccgaccctggccaatggggaaagggtacaggggcaggacttgtgtcaggaataaaggctcttgtgcccctttgttcaggtgtgctctcatggtgactggacaagaacgcacccctctgtgcagaactaaaattgctttgctaggaatcctttgttcgagtgttcaatttccttatgattttgagcgttattcctaacaggaagaaaagggatattcaggcctttcacagacctgacaacagagctgcacttcaatgtgacaggtattgaccatgtgtggctcctgggagcctggaatgtggctggtctgagctgcaatttgcaagaaaggtaaaatgcagagttagtttcaaagatttagttccataaatataaaaatatacaacatatagataaaaatatctatatataatatggataaaaatacatagcataatgcaatatatagatacataattatgttatatataaatatatatctcattcataattatacattgctcacatattaaaataatattttggatatattgctttaattaaattgttacaacagacggatgca

SEQ ID NO: 404917 - DNA, 394 bp, Homo sapiens
agaaggaactgaaagcagggacttgaacagatatttggacacccatgtccatagcagtgtgattagccagaaggtggaagcagcctacatgccctcagatggacggagtaatatgtggcatatacttacagtggcgtgttatccagccttggaaaaggaagaagatcctgacccaggccacggcatggatgaaccctgaggacgtgatactgagtgaagtaaggcagacacaaaaagacaaagactgcacctttttgagttttctaaagtggtcacagtcatagagacagaaagaggaatggtgggtcctgaactgtgcacttcgaaatggttaagatggtaaattttgttacatgtattttaccacaattaaatatgaaaatctaaagaaaaa

SEQ ID NO: 404918 - DNA, 779 bp, Homo sapiens
tgtcctgaatatacacttcaattaccacagtgacaagtgtttgctttttttttaaggaaaaaagaagcagtttctgagttgtttaccaataacttatgttaaaataagataagtttttattggctatacattcttatttatattatagattacagaaacatgaagataataggtgagacagctagtcaggaacagaatgtcttaaaaaagttgtcctcaggcataggttcagggatgtgactgacatctcatatattcttgcctctctgagcctgatacattttgtgtaggtcagacaggtctgggctatttttttttttcctcagccaatatccttctaaatatgtacacataggcaattggaaatagatgtaatcaataatttaaatgtattaaaatatttattgttagaatgttaatttacctgtaactctgcttatagtacaaagctttatatatatatcacatttccttaaaacattaagaagtgtgggctgggcacagtggctcatgcctgtaatcccagcactttgggaagcgaaggtgggcggatcacgaggtcaggagtttgagaccagcctggccaacatggtgaaactctgtctctactaaaaatacaaaaattacctgggcgtggtggcgggcgcctgtaatcccagctacttaggaggctgaggcaggagaatcgtttgaacccgggaggtggaggttccagtgagctgagattgtgccattgcactgcagcctgggcaacagggcgagacactgtctcaaaaaaa

SEQ ID NO: 404919 - DNA, 435 bp, Homo sapiens
tcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgcagcctaagcaataagagtgagaccctgcctcaaaaaaa

SEQ ID NO: 404920 - DNA, 533 bp, Homo sapiens
tcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactccagcctaagcaataagagtgagaccctgcctcaaaaaaa

SEQ ID NO: 404921 - DNA, 539 bp, Homo sapiens
cgtacacccaaggccctgagacagagtctcgctctgtcacccaggctggagtgcggtggcgcgatctcggctcactgcaagctctgcctcccgggttcactccattcttctgcctcagcctccccggcagctgggactacaggcgcataccgccacgcccagctaattttttgtatttttagaagagatggggtttaaccatgttagccagaatggtcttgatcttctgaccttgtgatccgcccgcctcagcctcccaaagtgctgggattacaggcaggagccaccacatccggcctattctactgctttttaaaaataattttgagtacttattctccttcccctcacctttgccaaaaatccatgacataactgataaaaatattttaggctgatttgctatttaattagaaatcaatttgaataataattctaaaatattaggacatagtctaaccccactaaaatcaaacaaaaacatcgttccctttacagagatctttaaaaactttgagcaagcaaaaaaaaaaaacttc

SEQ ID NO: 404922 - DNA, 484 bp, Homo sapiens
  misc_feature (441)..(441): n is a, c, g, or t
  misc_feature (464)..(464): n is a, c, g, or t
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagcggcacatgcgagggttatcctcagagtcnagtgcgtactagggcatcatggnacgaaagcaaatttgttccc

SEQ ID NO: 404923 - DNA, 463 bp, Homo sapiens
  misc_feature (444)..(444): n is a, c, g, or t
  misc_feature (446)..(446): n is a, c, g, or t
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagcggcacatggaaaggtatctaaagagtcgggancntactgatgtattctatg

SEQ ID NO: 404924 - DNA, 1410 bp, Homo sapiens
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtgacaaaacacaacacaaaaagg

SEQ ID NO: 404925 - DNA, 1299 bp, Homo sapiens
  misc_feature (1)..(1): n is a, c, g, or t
ntgctgttctgaggtttccgtagtggatcttggcttctctttcctctctcctccaggtggctgtcctgcctggtacttccagccaatctcgtgagccaggcgcccagataggcaaagtttcttgtaggcttcagacgcacgacttgagggcagcaggaaccaccatccgctttttcttgcccgcgtcatcctgcaaattccaggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404926 - DNA, 1337 bp, Homo sapiens
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcaggttagatggaaacaaacatggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtgaaaaaaaagaaaaaaaaaaaaaaagaaatgaaacaataaagagaacaggaaaaaacaaaagataaaaaaggaaacatacggaaaaaaatatgtacacacagacaagaatatgcccggaacacgctcaagacaaataaaaacaaaagaagagggggggggggaggcgggaaagaacataatctcaccacaccaggaggggaggaagagcaatgaaacacaagcaaacaccgagacgtagcgtattgaagaacaccggggacggcccaaccaacgaggttagacataacatagagacaagaagacagagcagaccggccataaaaagacaacgaggagacagacagcaaacacaaaaccgccaggagatagttataagagagcagaccaaccaacatctggtagagggaaacaaccaggaggggacgcaaccacacaa

SEQ ID NO: 404927 - DNA, 1389 bp, Homo sapiens
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404928 - DNA, 1599 bp, Homo sapiens
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtgaaaaaaaagaaaaaaaaaaaaaaagaaatgaaacaataaagagaacaggaaaaaacaaaagataaaaaaggaaacatacggaaaaaaatatgtacacacagacaagaatatgcccggaacacgctcaagacaaataaaaacaaaagaagagggggggggggaggcgggaaagaacataatctcaccacaccaggaggggaggaagagcaatgaaacacaagcaaacaccgagacgtagcgtattgaagaacaccggggacggcccaaccaacgaggttagacataacatagagacaagaagacagagcagaccggccataaaaagacaacgaggagacagacagcaaacacaaaaccgccaggagatagttataagagagcagaccaaccaacatctggtagagggaaacaaccaggaggggacgcaaccacacaa

SEQ ID NO: 404929 - DNA, 1900 bp, Homo sapiens
cgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggttgcccccgcagtgaaggttgcccgaggatggtcgggcctggcgttgggcgtgcggcgggctgtcttgcagcttccagggtgagagggtggcgagcagcggggggggcgctgcgaggaaggaagggggccacaggcaggccgcgtgggcccctagagagagcattgccctgggggccggagtatctggattcaagcttctaagttagctgcgtgaccctgcgccaatccgaaggtttagtgactacctctcgcctaaggagtctggctgatctagggttctaacgcggagctgaaagtgcggttcagctaaagagctcagatctgggatcgcctgtgaattgggatgggtgtgtaggcgccaagcccatccttaccgttagcacttgaccaggaggagactttacccgcctgcttggggaatgtcctcctacttgggacaagggcctgaattgttgtggctcaggtttagctcgcggtctccgcgccgctctccctcgtcggcgcgttggcagtcatgcctattgttaagtcaaacctactcgcttgtggagtcagcttttgcctgcctcctcctttccccccctcccaggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404930 - DNA, 1414 bp, Homo sapiens
  misc_feature (1)..(1): n is a, c, g, or t
ntgctgttctgaggtttccgtagtggatcttggcttctctttcctctctcctccaggtggctgtcctgcctggtacttccagccaatctcgtgagccaggcgcccagataggcaaagtttcttgtaggcttcagacgcacgacttgagggcagcaggaaccaccatccgctttttcttgcccgcgtcatcctgcaaattccaggctaactcaggtgagatggagccgctatagtcctgaattcaaggatcccttgattgacaaggaatattatcgcaagccagtggaggagctaactgaggaggagaaatatgttcgggagctcaagaagactcagctcatcaaagctgctccagcagggaaaacaagttctgtgtttgaagacccagtcatcaggttagatggaaacaaacacttgttacatggactgggactatcccagggagggtttctggtgaggattctgtgatacagccttggagagctaaacgtgttgcttttctctttgaagtaaattcaccaacatgatgatgataggaggaaacaaagtactggccagatccctcatgattcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404931 - DNA, 1200 bp, Homo sapiens
gattaacttccctgcatgtgtacgggctttaatgaagccctgtaagagtcagcaactgccattccttggtgtttcggaagtaaacacacaattaaaaaaaaaggaacaaataaaaaataaaacaactgccattccccacctcaccccccaccccctccatgccacaaatctcaatccactctttctgtcctagtctagcaaagggggaggcacttaaaaactttgttttggatgtgctgtgagaggagctgcattgccagcgcagaaccagaggatgggagtaaagggcaaggtactagcttggctgggtaaaccctttagggagcctggggcagcctcttccaccatattcttttgcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagctgtcacacaagctgctggaggctttccataaccagggccccgtgatcaagaggaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404932 - DNA, 1143 bp, Homo sapiens
gattaacttccctgcatgtgtacgggctttaatgaagccctgtaagagtcagcaactgccattccttggtgtttcggaagtaaacacacaattaaaaaaaaaggaacaaataaaaaataaaacaactgccattccccacctcaccccccaccccctccatgccacaaatctcaatccactctttctgtcctagtctagcaaagggggaggcacttaaaaactttgttttggatgtgctgtgagaggagctgcattgccagcgcagaaccagaggatgggagtaaagggcaaggtactagcttggctgggtaaaccctttagggagcctggggcagcctcttccaccatattcttttgcagactctggaagctgtgaaaaggaagcagtttgagaagtaccatgccgcttctgcagaggaacaggcaaccatcgaacgcaacccctacaccatcttccatcaagcactgaaaaactgtgagcctatgattgggctggtacccatcctcaagggaggccgtttctaccaggtccctgtacccctacccgaccggcgtcgccgcttcctagccatgaagtggatgatcactgagtgccgggataaaaagcaccagcggacactgatgccggagaagcatgacttgcacaagatggcagaggccaaccgtgccctggcccactaccgctggtggtagagtctccaggaggagcccagggccctctgccgcaagaaacagtgtgagctactgccacgctgaaaactacctgtgggttaaggatgtagttcctttgtaagggtgggcaggcctcgtaagaaagatgtagcagcatattcactatccgttaatccttctttctttgaggctggaacttgctctctctgcccctatttccttgtaaagagggagcacattgacttgggaatttcctccaggaaactcagggctgttttctcttcccttaggttggggcggacctttggacatataaaggaagcagttttagtatcagaaaagatttattagaaaattctcacgctgaactggtgtagcatgtggtgcagcattcagtgaaactggctggaggaaataggcttgtttccagagttgtccttatacaaaatgtataaaaagcagtttctggtg

SEQ ID NO: 404933 - DNA, 1196 bp, Homo sapiens
  misc_feature (877)..(877): n is a, c, g, or t
  misc_feature (880)..(880): n is a, c, g, or t
  misc_feature (882)..(882): n is a, c, g, or t
  misc_feature (884)..(884): n is a, c, g, or t
ggacgcgtgggtcgacccacgcgtccgcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgcctctggcccttcctgggcatcgtggctgaggtgctggtgctggtcaaccatcatcttcatctacgagaagcgccggaagcccgaggacgtcctggatgatgacgacggcgggtctgacccctgcaagagcagcgggcagcaccggaaggacaaggcaagaacgtccgncanangnaactctctggaggacagtggccgaggaaccacacgaacacagactgtgaccccgaccggagcaccatcacgcggcgagcagatcacagggtctcagcgtgaaggaaacgcgcaccgagatccacaagaagccactatataaaacaggggtaccacagaggaatcgggcagcaaatacatccacgagggtaccaacgagcgagcgacgtgaccaggggcaaccggcgagctaccgggggacacaccgcgaaaaccagattaacagacggccagcactaactcagcacgttgtgcgccgcgccgcgacgcatgt

SEQ ID NO: 404934 - DNA, 1353 bp, Homo sapiens
  misc_feature (1034)..(1034): n is a, c, g, or t
  misc_feature (1037)..(1037): n is a, c, g, or t
  misc_feature (1039)..(1039): n is a, c, g, or t
  misc_feature (1041)..(1041): n is a, c, g, or t
ggacgcgtgggtcgacccacgcgtccgcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgcctctggcccttcctgggcatcgtggctgaggtgctggtgctggtcaaccatcatcttcatctacgagaagcgccggaagcccgaggacgtcctggatgatgacgacggcgggtctgacccctgcaagagcagcgggcagcaccggaaggacaaggcaagaacgtccgncanangnaactctctggaggacagtggccgaggaaccacacgaacacagactgtgaccccgaccggagcaccatcacgcggcgagcagatcacagggtctcagcgtgaaggaaacgcgcaccgagatccacaagaagccactatataaaacaggggtaccacagaggaatcgggcagcaaatacatccacgagggtaccaacgagcgagcgacgtgaccaggggcaaccggcgagctaccgggggacacaccgcgaaaaccagattaacagacggccagcactaactcagcacgttgtgcgccgcgccgcgacgcatgt

SEQ ID NO: 404935 - DNA, 434 bp, Homo sapiens
cgatgattaattttgaaaagttactcaaacaattacaattcaacttggtcaacatcagttctcacaaatagaagctgactgtcatttattcactcagttcctgttggctgagtgttggctctagggctggcaccaggcactggaattaaacattctggactccagaggggcatgaaaactcttcctgaaggagatgcagaggaagattcgaactggaggaaaaccctaaaatgataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404936 - DNA, 1991 bp, Homo sapiens
catggacatgaatgtgtggcttaaattacattgctgtgtgggcatgaatcagacgctctgcccatgaagagttctagcaccaagtcagtgcaagacccgaggtgtggctgagtgttggctctagggctggcaccaggcactggaattaaacattctggactccagaggggcatgaaaactcttcctgaaggagatgcagaggaagattcgaactggaggaaaaccctaaaataaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404937 - DNA, 1863 bp, Homo sapiens
catggacatgaatgtgtggcttaaattacattgctgtgtgggcatgaatcagacgctctgcccatgaagagttctagcaccaagtcagtgcaagacccgaggtgaaacaataacaacaaaagttcaaaacctgaaaagtgaaccatgaagctcagtaaaaaggaccgaggagaagatgaagaaagtgattcagcgaaaaagaaattggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404938 - DNA, 1920 bp, Homo sapiens
gtttcaggaatcctcacgcaacccggaaggaacgcaagggcgtggccgctaaacctgagggcgcccggcctgcgcacgcggacctggactggaaccctacttgcaggtccccaacttgcgtctcttctctctgtctctaccccagccaaggacaaagacttctcctccggaaggcctcccccagctgagggaacgttccaggtcttccctcggccctggctgcgcgcccggtgccggctctgacgtggtttcctctcccctcaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404939 - DNA, 3135 bp, Homo sapiens
ggaaatgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaacagctcaaaggaactaagacaaagatcatggagaccatcgggtgagtctcaagacttcccccagctctgcttggctggtctcctgctggtattttctgtctgtagagaggaacaagaacttccattttatcttgcttacctgcacttatgaaaagtcaaactgagtcatgctgagagccagggaacataggagtcagttcttctgcagcagcactcagccagttgaaggcaatgtggagtgatggaaggagagcagtgatgcagtgatgctggcaccaactcctttactatggcatccattgtaccagctgccatacaccaggcaacttctacactttatctctaatcatcctagaataagtattagtttccccatcttctagaaaggaaaactcagacccagagacactaagcaagtagctcaacatcacacacgttatctgtgattaagcctgagttagaaatggagccttgggatttccacatttatgctcttttcatgaaggctacctgactttgatactcaagtttgtcctctacaacgggactgctggactagaaatctctaagtcccctttacctctggattctgtgtctctaaggatgagaataacaaaactcctttgcctctagcactttccaactgaaggccctatcacgctcatgacatctaatcactgcagccagaagcattaaataaaatggatggattgacattgggggtgggtgaggcggggaagttgggggtgtggagaaacaactctctttacataatgattgctactatgatttggttataagtaacccatgaagacaatcaggcttctctggcagtccctaattgtagtgaatgttggaatacagtgaccacacaaatgctccagactgattgcgaaggtgccacttctaaatcagctgggcaagtgcattgcataagctgagtatttagcttaatgattggagccagttgatgaaacacaagaatctggaagcctcctgctacttctcagaagataagacaatggcattccatcaccagtgtttactgtggtacccaaagggagctccagttactttcctctgtgcctgtaacccttggatcacctggttgcaccagacccatcctgactaaaatccctccaaaggaccaaagaggggatagggacaaaaataaaaaataaatctcatctgctctctttcctaaggacccagcagcctctatccatccatcgttcattcactcattccacacactttcatctagcccctgctgaatgccaagcactgggctggaactctggggactgtggaggtggaataggagaatatgggctttctgtgagcagtgtttgcctaaaatatatacatcaaggttgtaggatcatgtgcaccactgcactctagcctgggcgcagagtgagaccctgtttcaaaaaaataaaaaaattgtaggatcatggaaaaaaagt

SEQ ID NO: 404940 - DNA, 2873 bp, Homo sapiens
ggaaatgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaacagctcaaaggaactaagacaaagatcatggagaccatcgggtgagtctcaagacttcccccagctctgcttggctggtctcctgctggtattttctgtctgtagagaggaacaagaacttccattttatcttgcttacctgcacttatgaaaagtcaaactgagtcatgctgagagccagggaacataggagtcagttcttctgcagcagcactcagccagttgaaggcaatgtggagtgatggaaggagagcagtgatgcagtgatgctggcaccaactcctttactatggcatccattgtaccagctgccatacaccaggcaacttctacactttatctctaatcatcctagaataagtattagtttccccatcttctagaaaggaaaactcagacccagagacactaagcaagtagctcaacatcacacacgttatctgtgattaagcctgagttagaaatggagccttgggatttccacatttatgctcttttcatgaaggctacctgactttgatactcaagtttgtcctctacaacgggactgctggactagaaatctctaagtcccctttacctctggattctgtgtctctaaggatgagaataacaaaactcctttgcctctagcactttccaactgaaggccctatcacgctcatgacatctaatcactgcagccagaagcattaaataaaatggatggattgacattgggggtgggtgaggcggggaagttgggggtgtggagaaacaactctctttacataatgattgctactatgatttggttataagtaacccatgaagacaatcaggcttctctggcagtccctaattgtagtgaatgttggaatacagtgaccacacaaatgctccagactgattgcgaaggtgccacttctaaatcagctgggcaagtgcattgcataagctgagtatttagcttaatgattggagccagttgatgaaacacaagaatctggaagcctcctgctacttctcagaagataagacaatggcattccatcaccagtgtttactgtggtacccaaagggagctccagttactttcctctgtgcctgtaacccttggatcacctggttgcaccagacccatcctgactaaaatccctccaaaggaccaaagaggggatagggacaaaaataaaaaataaatctcatctgctctctttcctaagga

SEQ ID NO: 404941 - DNA, 1893 bp, Homo sapiens
ggaaatgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaatgacctcatgtcaagaaggcagacctgcagaaatgaatgtgcctggatacctgagtcaccaggtgaaggaaactcccattgacctgcatcacactccagatatgaaacccttctttttctgcactgtcactgaggttagggattattactcactgcagcttagcctagcattaagttgcttgactaatataagtttcaataaatgttgctccatttcacatggcttc

SEQ ID NO: 404942 - DNA, 812 bp, Homo sapiens
catggacatgaatgtgtggcttaaattacattgctgtgtgggcatgaatcagacgctctgcccatgaagagttctagcaccaagtcagtgcaagacccgaggtgtggctgagtgttggctctagggctggcaccaggcactggaattaaacattctggactccagaggggcatgaaaactcttcctgaaggagatgcagaggaagattcgaactggaggaaaaccctaaaatgacgtggacagctaactagctagatggatggatggatggatggatgggatttattatggaattggctcacatgattatggaggctgagaagtcccttgacaggccatctgcaagctggagaccctgggattctggcggcacggctcagtccaaatccagaagcttcagcaccaggaaagccaatggtaattctcagtctgacgccaaaggcctgagaaccagagcaatggatgggacgctggtgcaagtcctaaagtccaaaggtcagggagctcggagttctgaccttcaagagcaggagaagaagagtatcccagctccaggagagagacagacagagaaacaaaacaaaacaaaacaaacaaacaaaaaaagtgcctttttttctgcccattttgtttgatctagaccaccagtcgatggatggtgcctgccccccactggagggcagatctgctcccttcagtccacagactcccacaccagtctcctccagaaacgccttcacagacacaccccaaagtgaggcttgaccagctttctagggattctttaattcaggcacctgaaattaagcatc

SEQ ID NO: 404943 - DNA, 388 bp, Homo sapiens
caatagtgatgagggatctccagctatctgtgcactctctatgcttcccagactctttggcagttgtgttgggtactggctgagttctggaaaacaggaatgtgagcagagtgctgcagatctccttgtcaggagcacctaagaactggcatgactctacaccctctctccttctgcagtgacctcatgtcaagaaggcagacctgcagaaatgaatgtgcctggatacctgagtcaccaggtgaaggaaactcccattgacctgcatcacactccagatatgaaacccttctttttctgcactgtcactgaggttagggattattactcactgcagcttagcctagcattaagttgcttgactaatataagtttcaataaatgttgc

SEQ ID NO: 404944 - DNA, 1868 bp, Homo sapiens
ggaaatgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404945 - DNA, 363 bp, Homo sapiens
ccgccaccaaaaaagaacacccattgtaaacggtcatgtggtatttcctcaacctggaatgaccttcccctatcttcttctcctggagaacaccaagtcatgatgtcagacaagagcttggattttggagacatggtgacctcatgtcaagaaggcagacctgcagaaatgaatgtgcctggatacctgagtcaccaggtgaaggaaactcccattgacctgcatcacactccagatatgaaacccttctttttctgcactgtcactgaggttagggattattactcactgcagcttagcctagcattaagttgcttgactaatataagtttcaataaatgttgctccatttcacatggcttc

SEQ ID NO: 404946 - DNA, 1816 bp, Homo sapiens
ggaaatgccttggcagagtctggggtccctggactgagccatcagctgggtcactgagacccatggcaaggaaacaaaataggaattccaaggaactgggcctagttcccctcacagatgacaccagccacgccaggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtacctcagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctctggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaaaaaagcaact

SEQ ID NO: 404947 - DNA, 828 bp, Homo sapiens
gtttcaggaatcctcacgcaacccggaaggaacgcaagggcgtggccgctaaacctgagggcgcccggcctgcgcacgcggacctggactggaaccctacttgcaggtccccaacttgcgtctcttctctctgtctctaccccagccaaggacaaagacttctcctccggaaggcctcccccagctgagggaacgttccaggtcttccctcggccctggctgcgcgcccggtgccggctctgacgtggtttcctctcccctcaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactctgctctggtctgtgactgtgtccatattcgccatcggtggacttgtggggacattaattgtgaagatgattggaaaggttcttgggagcatcctgggagccagtgagcagtgtgtggaaagagtagagcttctccaagtgatggaggagtcgtcacatcaatctgatggggccagaacattcgtgtcttaacttgaatcatgtgtcttccacttactagctgtgtgcccttggccaaatcatttaatttatttgagcctcaattttcttatctgtaaaatagggatgatagtttctacctgcagggaatgttacaagagttagaccaaatgaatggaaggagaatggccatgagttgtagctgaataaataaaaattcttgtcattgaccac

SEQ ID NO: 404948 - DNA, 371 bp, Homo sapiens
attctgagatgctactactagacttgaggaccactgtgttgaatgatggaaccagaattcaagaagaccttaacaggcttgagcaatgtgccaaaaaagacaagatacatttagaatctttctaagttcgatccccatttttcaccctgctccatggctggaggctgatctttatggatttcatcaatggtgtccctcaccctctggtatccagtaggccaaggaagagtcccctcaggagagtggaggaagagaaaagagagcaatctgggtaatgatgattgaatgagttatcacctataaagagcatccctagaacaaaataagtatgttttaaataaatacaaataaaaattccaatcctcactgta

SEQ ID NO: 404949 - DNA, 377 bp, Homo sapiens
cttgtttccctgtgtgtgtagtgatgtatggctgcagcttgtcaaaagattctgggtctgctgtgatactgggtgcgtctaggctaggagtatagctagagaggacattccattgtagtggaagattggaggtgggcaggtcttttctactcctgagaagtctaggaaagaattactgaaaacaaccatctgtaaggaaaatatttttttatccagcctaacttttcattatcattataagtctaacctatttccttttgcttcatctgtcctctgatagtcaggagactgtatgccccaaatcctgctccatgttttgtaaaaaacagttttttctatgcttaaccagcttctctaaaaataaatctttagatata

SEQ ID NO: 404950 - DNA, 370 bp, Homo sapiens
caccgacgagagtgctggggaataaaaaggggatcttcactcggcagagacaaccaaaaagtgcagcgttccttttgcgagagagatactggaagattgccaatgaaaccaggtatccccactcagtagccaagtcacaatgtttggaaaacagcctgtttacttgagcaagactgataccacctgcgtgtcccttcctccccgagtcagggcgacttccacagcagcagaacaagtgcctcctggactgttcacggcagaccagaacgtttctggcctgggttttgtggtcatctattctagcagggaacactaaaggtggaaataaaagattttctattatggaaataaagagttggcatgaaagtgg

SEQ ID NO: 404951 - DNA, 1629 bp, Homo sapiens
tgcaagcagcttttagccctggcagcacagaagcagaagaattgaggaattctctgccactcctgtagtatcctttaacaggttaagtggttgtcaagcttcttttttaaatttgtaaacctatttgaatcaatttgtgactcctgcattccggcccggcagaaagagctcgaagagacgcagagcgcggcgcgctcccccacggccctccaggccggcgggtgagatggggagatgagctagggggccccggactggctgcgccctctgccctgcagacacggggggccccgctgtggctgcccactggccgggcgcaggcctcgaagccgcggcgaacctctcttccccaccccacctcggtgactgttggcggcggcctctccctgcccagaccccgccgccggatcctgcccggcctcgacgaaaccccgccgagccgccgagacgcagtgtctccgggtggcggcgggagaggcgggccgggaagcatggcggccgccccaacaccgcgcggcggagaccgttagggtgtgcagggcccgggaaggcggtctcgcgacgcaggcaagctcggccgcctctttaggccacggagccgcgcgagtccgggcccgggtgaccgctctgttcccactggacgagacctgccgagtcctcaggacaacggacaaaggccttaacgggcttgggaggtgagcgaagtcccgaacgatgacgggtggaacagttagcggccttcgggcggttggtctcgttctaccagagcttgctgtcggaagagagaaatggtggaatgacaagccacgtctggcctcttggaaatgcccaccaccctttgggaagatttactggccgtttatggaaggcctgtgtatttaatatgaaacagctgctctcaacactacccaaaccttttaatagaaaacatttgccacatctagcccttctatgagctagatggaaagaggttgctgatgtatgataaagttagaaaatcacacatcttgtaaattctcatttgcttaaaagaaatcatagaaaataaatgtcttctggagacgacttttggaaatggagttgttaacacggcctctggaagcgagacgtccacgtttgttaagtggtttagaggacatggagctggaagacctgagaaggaagagaagaagcttctgtgccagactggtcatatttagaagacattttcatattctctccattgttttgtgtgcatttcattcctcactactgtgtatatggttgacaatgctaagcttttttgaaatgtctattctttttagatattctgaagtgcctgatatatgtagaaaaaaataaccttttgtaaatatctttttgttacaattcatatgaaatgtttggtgggggaatggcccaatcacctgttgagtaatactcattgtgtttgtgcactggttcaggggaggagggggaagtgcagagatctctatgccactgtgcttacagcgaggcaagattaatcattatctctgcgcattttgttttacttgtctgtgtatatagtgtacataaaggacagacaagtcctgatttacaacatctagtctttctagatattaaagaggttgccagtacatgataaaa

SEQ ID NO: 404952 - DNA, 365 bp, Homo sapiens
ccaatcatgagttctttaacattattagtcatcaggaaaatgctaattaaaaaccacaatgagatgccactagaataaaattaaaaagatatctaactccaaatgttgaactctcatacttccttagtgaaagtgttataacacttctctattaatgtccattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattccttttttatgaagttcaagaacagacaaaattaatctacggtttaagaaatcagaacag

SEQ ID NO: 404953 - DNA, 309 bp, Homo sapiens
cctatcctcgttcatcaagagattgcattgggatttggaatccgggaacttaagagtatttgccttatcttatccttcgtcatgccctacaaaatgtgtttaatccaccatgagactactgccagatctgaccaggcctcaaaagatcacttcttaggaatctctgaagttttggagagatattagtcctgggtcctgcaatgtgagcagattcaactgagcaaatgtatatagcaaaaagaatttcaggtctaccaaaaggtaagttctgacatggcttcaaatatatgcctcacttatgtaaccaat

SEQ ID NO: 404954 - DNA, 485 bp, Homo sapiens
tgtactaccccaagcccatcaataccacttttcaaccttaacttgctggtgtagtttctactggtttccaaacatgctaataagaacagctaaaagttactgagcacttattacttgccaggcattgctttaagcgtgttacatgtttaattcatttaatcctcttccatcccctttttacaggggaagaaacttaagcataagtgaaaataacttgccttacatcacgaagtatgaaggagcagggatgcgaatactaattgtaaagtccctgctcctgtgtacaacaaggaagacaaatcataatctcaaatgcaagcttcaaatcccaaaattcagatttgggaaaggggattaggatgccaaataggaatactgacctgtaaaaagaaaaagtaactttaggcattctccacaaaacagtgtgagggaaaatggtaatctttttattctttgggcgtacggggatccccgtacgcccaaat

SEQ ID NO: 404955 - DNA, 395 bp, Homo sapiens
tctgagcagacatgctctggaaaacacagacattctcagaaaactgcagtctgctgaaaatgccaggagagttcaggagactggactcttcattaggccttggcatgtttcattgtttttgcatagggaatggtgtcaacacttcttatctgaacatctgtatgtccaactctttttttctaatcctgtttcaaatggacaagatcttaggacacaagagaagatgtgtgcttgggacaaagcatatgaccattgctggacttctgaaatctaaatcagatcatcactgcagctaatagatgctggccttttttgcagtgagttacctctaatatacacttactgaaagcacacatcttcacagctgaaaataaaaataaaatatattccattac

SEQ ID NO: 404956 - DNA, 344 bp, Homo sapiens
tgacccacagagcacggaagcgaggctcagaaacagctggattgactacagctcggcatcggcctcatttgaacatggtttgaacagttggctgcctgagatcagccaaaacagtgcttggtataaaagtaggtcacgggctgtttacacctccagttaggttacagtttactatgtacgaaaaaacctttcagccgaacttaaaatacctaaggaggcagctgtggggtaaacttaatataacacattgctgctgtaacaaatcactacaaacttagtgacttcaaacagcacaaacttattacttaccagtttgcaagatcagaagtccaaaatatgaatct

SEQ ID NO: 404957 - DNA, 664 bp, Homo sapiens
gaaattgattttcaggatcatggggtgctggctaggcaagtttgaaatatataaagcaggccagcaggctggaaattctcaggcaggagttggcacttcagacttgaggcagaatttcttctccttcagggaaattttagttttgctgttaagaccttccaactgactgggtgagctatggttttcatggataatctcctttgtttaaagtcaactgactgtagaagttaatcatatctacaaaaaccttacagcgacacccagattagtgtttgattgattaattatagcctagccaagttgacacgtaaaagtaaccatcacagtgacttacctcaaacatttggtgatcttagcctgcctgttcatatttaagggtgagatctagaaaaactggtgggggtatttataggagaagattgccaactggaaatcattgctttagggtgaccaagaggaggtatagaatcttataatgggaaacccctaaataccagattgggaagtttttccctccagagggccttcaatttcccctgaaaagtctctactcccttgggaggaggggatgtgctatgtgtgggtgctgtccttcgataatgagtggatctggggaggcaggagggacttttcccacattagagtcttttaatgaatgtcactg

SEQ ID NO: 404958 - DNA, 617 bp, Homo sapiens
ctcaggaacagccttctcctgcctcctctgcacctggacaactcaactcctgccaagatgtcctgccagcagaaccagcagcagtgccaacccccacccaagtgtccctcacccaagtgtcccccaaagagcccagtacagtgtctgcctccagcttcctctggctgtgccccaagctctgggggctgtggccctagctccgagggcggctgcttcctgaaccaccacaggcgccaccaccgatgccggcgccagaggcccaactcctgtgacaggggcagtggtcagcaaggcgggggctctggctgcggccatggctctggaggctgctgctgacctggatcctgatgctgagacaagcgattttggaggaaacaagaatcccaagggcccaggaaaaccccatcttgatgcatgagttcccagataccctcttctggctttcacaggctgagctaggggttttcctgtggaaggtctgagctctccccagaaggcacttcctgtctgatgtccaggatgtcacatgttcccttacccctgtacctgtgaaggattggcagtgcttgtgcctgacctcatcaaaaaataaagctccttgtcctcattaaaaaaaa

SEQ ID NO: 404959 - DNA, 711 bp, Homo sapiens
catctggcatgtcccaccaactccacatcagcttccctcaccttcctgcagctcttgcctcaggaggccgctggtcttagagacattggactgtagattttggactaacaaatggctttgttttgtccaggacaactcaactcctgccaagatgtcctgccagcagaaccagcagcagtgccaacccccacccaagtgtccctcacccaagtgtcccccaaagagcccagtacagtgtctgcctccagcttcctctggctgtgccccaagctctgggggctgtggccctagctccgagggcggctgcttcctgaaccaccacaggcgccaccaccgatgccggcgccagaggcccaactcctgtgacaggggcagtggtcagcaaggcgggggctctggctgcggccatggctctggaggctgctgctgacctggatcctgatgctgagacaagcgattttggaggaaacaagaatcccaagggcccaggaaaaccccatcttgatgcatgagttcccagataccctcttctggctttcacaggctgagctaggggttttcctgtggaaggtctgagctctccccagaaggcacttcctgtctgatgtccaggatgtcacatgttcccttacccctgtacctgtgaaggattggcagtgcttgtgcctgacctcatcaaaaaataaagctccttgtcctcattaaaaaaaa

SEQ ID NO: 404960 - DNA, 683 bp, Homo sapiens
agggaactgcaggtacaaaagtccaggggcaagagagagtacagacaaggtccagttctactgcagacttttggggaagggataatgctagaggagaggctggagagtgagacagacctcataatacagagtacagacttcaacccaagggcagtgagaaatcattgaaagtttgttttagcagggaaataaaacgacaggttttgcctacaggcagtccccaactcaacgatggttcgacttaggatttttcaactttacgatggtgcgaaatgattcagtatgctcctcaccttatgatgcagttatatcagataaacccattttaagctgaaaatatggtgaagttgaagaagcacttctgccttacgatattttcaatttataatggatgggtttattcagacataactccattgtaagtcgtaaagcttctgtactgaaaaaaatcacttgacctcagggtataagatggattgcagggagcaagccttggccaggagacttttgcattggtttcggagaggaaagacggtgacttgacatatatagtggtgatgaggggaggacagatttggaagatgtttaggaagcagaattaatagaacttggggattgataggacttggttggatttgaggtaaggggagaggacatagggttgacgctcagatttctagttt

SEQ ID NO: 404961 - DNA, 109 bp, Homo sapiens
gttattaaccatgtagatttttaaaatataactaccatgtgtgctttaattttgaccattatagtttttggctatcgaagactgtgatcgagactgatctaaggttaat

SEQ ID NO: 404962 - DNA, 433 bp, Homo sapiens
aataatgtgcaaatgttttttgcattcaaagcacatccacatctgttggaagaccttaaatgagtttttgttcttagataacccacattagttgaatgtgttaagtaaaacgatacttgtaccccccccccccacccctttgtcaactgctgtgaatgctgtatggtgtgtgttctcttctgttactgatatgtaagtgtggtgatgtgaactaaagctgatgggttgagaacatggactgagcttgtaatgtgctttgcaggagtacttggaagcagagttcaccagtgagctcaggtgtctcaaagaagggtggaagttctaatgtctgttagctagccataagaatgctgtttgctgcagttctgtgtcctgtgcttggatgctttttataagagttgtcaatgttggaaattcttaaaactgatttaaa

SEQ ID NO: 404963 - DNA, 754 bp, Homo sapiens
cccactgtttcctttctgctggctggcctgcacactagcctgcctttgtgaggaagcggctgttaagcagacacagcaggagaagtttagaagtcaggagtttcattccttgcctaatgaaaagggatgcagacttgtggctgaggccaacagggaaaggcagtatggggagcaggaattagtgtttgctctgtggagcagataaggtggaagccagcctgcggtctgcctaccttcccatgtctcaaagacagagctccacaaatctatcccagagaaactgggttatgtgagatgcagaggagaaccccactgagaagtggtagcaaggcagtacaccttgttttcagcagagcctgggtctccatgtcatgtatcctcatagcctggaataaagatggtactctccctttgcagatagtggtggcaggcctcccctcttggaatttgctcctctcctctgtgagattcattcctgaattcctacttcccccagatactctttcgtggagaatctcttgctgtggcatcagacttgtgacaagcagagggaggttttctggaaatggctcactcagcatcgttcctgcagcagtgtgggaaccagaagtgaagaagcctctgcacagggaaaggagacctgtgctgccgcaggttattctgctcttttttcacagatccctcccactttgcaagcctgggtctagtgtgctactaagaggctagagtgcttcctgggtgggcatatttgaat

SEQ ID NO: 404964 - DNA, 708 bp, Homo sapiens
aaacaaaaggaaagaattctttagtgataatgaagacaccataagtccctatggcttccttctatcaaggatgaagtatgggattcaaaatagggtattttggccagtgttaggatattctacaatgagattatgatagaaggcatagtggaagcaatgaaaaattttaaaaacttcttttatctccacaactgttgctaaaaaatgtcttgctcttgagggagggtcccttgagaatacaaaaaagaacattagaaatattaaaagataaacatggcatttatgtagttaaacataagcaattatttcatctatattaatctcccatccctaggtgcatgcttagcttaaaagaaaagcatctttaacaggagcactagaggtctacagcactatacttgatcttccacttcacatgcaggaagaggtggtctgatatgaggctttacaaggattcctaagcagggctgctatggtttgaatgtttgaacgggccgggattacaggcatgaatcaatgagcccagccatgactaccattctgtggtagtttaccaagagacaagagctaggcacacaaatatgaggttttcttcagatccttccataagtactatttaataaacacaagtttaagaagagttttgaaaaagttatattattaccattgatagaattataatagcatagctctcttcaaatcattacc

SEQ ID NO: 404965 - DNA, 443 bp, Homo sapiens
cgaagtcactcataagtccattgacacaaggggaaccataatggcaagaaagttggtatggaaggacagatactattaatatataattccatttatccaaggtacttagagcagtcagtttagagacagaaagtagaatggtggttgccaggggctgaggaaaggggaaaagaatgaagttgttgtttaatgtgtgcagaatttcagatgtgcaagatgaaaaagttctggagatctgttgcacagcagagtgaatatacataatgctactgaactatacacttaaaaatggttaagatgatcagttttttgtgtttttttaaccacaataaaaattttcagaccaggtgccgtggctcaatcctagcactttgggagaccaaagtgggagggttgtttgaacccaaaaattgagaccagcatagattcccatcgctaccaaa

SEQ ID NO: 404966 - DNA, 610 bp, Homo sapiens
gcaggcagtccaggcaggggaagggaggagcaagaaaggatctcagaggtcagcagcaaagggaagcaggcagcagaagaaagcactatatgatcatgtatgctcagctaacagcaccacacttgcgtctgctgggtcatctagttggcgttatttgagaactaataaagatccctttttcaggttctctctactttctcaggaaataaacagcagcaaagcccagagcttataaagcacaagactggttattttgatgggggtcaggaaagacagggatattgggcatgtaccctctagggcagaccaggtagaaaacccagaaagttgcttgaaggtactgagttccaggttaggagtgcagagaagagagaaacaggaagcagaaagtggggagtggcttagcacaaacacaacacaatgtttacatacttcacaatgatgccaatgctgcaaatggcaacactgagtcaacagcattaggcaccaggacacttagctcctggccttcagggagcagtgggaagaaaaccctgcagggtggtgacaggcagtctccctcttcacgcactctggggaaccatggccttggcactgcgctgggcacctt

SEQ ID NO: 404967 - DNA, 597 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 404968 - DNA, 521 bp, Homo sapiens
gtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaagtgtaatgagtgtggaaaagcctttagaggacattcaaacctaactacccacagagtgccatccctgagagaccagaccgctccccaatactctcctaaaataaacatgaagcacaaaaa

SEQ ID NO: 404969 - DNA, 586 bp, Homo sapiens
acagtggctggagtgtggggggaagaaactacagaggggaaattgagaaatgcctctctgaggaggtgacgtgagctgagacttgaagggagaggggatctaggggaacagagttttaggcagaggaaacagcacacgcagggaccctgaggctggggcacactgatgaggcagaggagaagggggaacattgaatgtacttgaataaaatccggatctctttcatggctataaggctgaagaagctgccaggggccttgcaggccactgggagaaggctggattttatttggtgggtcccttccactgatggcccccattcctttaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagatatcatcatatccaccccacaacttttgcaacagccagccaaatttgggacgatctgctatataagttccccaagg

SEQ ID NO: 404970 - DNA, 746 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcggtaggcctagacccagcagtccctctctctacctcccagagacctccctgtctccgtctctcccacaccctttccaaacctccctgccgctgacccccctccccacagttcccagcacacactgacctcccctgacccctgtgctgcagattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 404971 - DNA, 564 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 404972 - DNA, 781 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaagggggggggcccggcctgaaaagttttaaaaccattctttgggccggggccaaagaggaactgtcaaagggtccaggaaccggcagaaaggggggttccccaaaaagcccggggacgggttgaaaacccaaggttcgggccggtccacaggacccgggcgatac

SEQ ID NO: 404973 - DNA, 1035 bp, Homo sapiens
acagtggctggagtgtggggggaagaaactacagaggggaaattgagaaatgcctctctgaggaggtgacgtgagctgagacttgaagggagaggggatctaggggaacagagttttaggcagaggaaacagcacacgcagggaccctgaggctggggcacactgatgaggcagaggagaagggggaacattgaatgtacttgaataaaatccggatctctttcatggctataaggctgaagaagctgccaggggccttgcaggccactgggagaaggctggattttatttggtgggtcccttccactgatggcccccattcctttaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttgggccaagccgattttagattcggccaggtttatccatgcggccgaatttggggctaattgggccaattcgccctatggggggccgtttaacaattaatgggccggggttttaaaacgttggaactgggaaaaccttggggttcccaaattaaatccccttgaggaaaatccccttttggccagttggcgaaatagcgaaggggcccgaacggacgcgctttccaaaaagtgtggcacccggaagggccaaggaaaattgaaggcggtaaaatttggtaaaaatccgggtaaaattttggtaaaataggctattttttacccaatggcccaaatcggatttgggacaagggtcccttttaaagaacgcg

SEQ ID NO: 404974 - DNA, 1154 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtggtgagttaggggcttccgtggctgcctcccgggtccctgggctcagcttggggcagggcagggagtggggtggaacgagagaaccaaaagtgggtgttgggatgggagcaggtccccaacctcccaaagcctgtgggtttctcccagagcccaagcccccaagttttgtcgtccgctacaagcaggggagaagagacatctaagtgtgttgccacaggacaagttgtgcagaagtaacgcacatagtccggtggcccagacgccagccccctgagtcccgccagacacgctctcccccttgctaacctcttggctgtcaggatccaccttccctggcttctaaacttgcctcccccacccccgtcataactctgtgcctcagtttaccttctttttcctcctcaggtctccgtcctgtccaggcccaggcccagagcggtaggcctagacccagcagtccctctctctacctcccagagacctccctgtctccgtctctcccacaccctttccaaacctccctgccgctgacccccctccccacagttcccagcacacactgacctcccctgacccctgtgctgcagattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 404975 - DNA, 982 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaaaaaggggggggggttaaaaatttcccccggggggcccaagtttagggttaacccagtttttttgtacaagagggggccccttataggaagccgtatttaataagcgcaaggaacggggcccgatggttttaacaaagcgtttcggtgagtgggaaaaaacgttgccaagcttggggactcgtgtgtggagggaccctttaaattttggggggtgggtgacaattgtggagacaacattacctaagagagatttaagagctcaggggtaattataaaattttcaagggtgctaatgtgtgtaaccaagcgtgaaaatgattgcgtgtgaaaatttggtagggagtattattttagaatttttgcgg

SEQ ID NO: 404976 - DNA, 1072 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttgtggcccgcttgggccaagccgattttagattcggccaggtttatccatgcggccgaatttggggctaattgggccaattcgccctatggggggccgtttaacaattaatgggccggggttttaaaacgttggaactgggaaaaccttggggttcccaaattaaatccccttgaggaaaatccccttttggccagttggcgaaatagcgaaggggcccgaacggacgcgctttccaaaaagtgtggcacccggaagggccaaggaaaattgaaggcggtaaaatttggtaaaaatccgggtaaaattttggtaaaataggctattttttacccaatggcccaaatcggatttgggacaagggtcccttttaaagaacgcg

SEQ ID NO: 404977 - DNA, 616 bp, Homo sapiens
  misc_feature (605)..(605): n is a, c, g, or t
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattcctggataattgtttttgtgttttttatagagacagcatcttgctatgtcgcccaggctggtctcaaactactgaactcaagcgatctgcccacctggacctncaaaagtggag

SEQ ID NO: 404978 - DNA, 1107 bp, Homo sapiens
cctcgacactgttggcctactgacttgcctggacgctgcgccacatcccaccggcccttacactgtggtgtccagcagcatccggcttcatggggggacttgaaccctgcagcaggctcctgctcctgcctctcctgctggctgtaagtggtggtgagttaggggcttccgtggctgcctcccgggtccctgggctcagcttggggcagggcagggagtggggtggaacgagagaaccaaaagtgggtgttgggatgggagcaggtccccaacctcccaaagcctgtgggtttctcccagagcccaagcccccaagttttgtcgtccgctacaagcaggggagaagagacatctaagtgtgttgccacaggacaagttgtgcagaagtaacgcacatagtccggtggcccagacgccagccccctgagtcccgccagacacgctctcccccttgctaacctcttggctgtcaggatccaccttccctggcttctaaacttgcctcccccacccccgtcataactctgtgcctcagtttaccttctttttcctcctcaggtctccgtcctgtccaggcccaggcccagagcggtaggcctagacccagcagtccctctctctacctcccagagacctccctgtctccgtctctcccacaccctttccaaacctccctgccgctgacccccctccccacagttcccagcacacactgacctcccctgacccctgtgctgcagattgcagttgctctacggtgagcccgggcgtgctggcagggatcgtgatgggagacctggtgctgacagtgctcattgccctggccgtgtacttcctgggccggctggtccctcgggggcgaggggctgcggagggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaa

SEQ ID NO: 404979 - DNA, 366 bp, Homo sapiens
acctaaatagcctcatgtggctagtgggtactgtatttgggtaatgcagatgctatttcaaagatctaagaatatttccaagcaatctaacccctgtcactctcttggcctatataataatgctcttaagaaagaaacaggaagggtgcggtagctcacacctgtatcccaacactttgggagatggaggagggaggatcacttgagcctaagagatcgagaccagcctgggcaacatagggagaccccatctctacagaaaaggctgaggtgggaggatcgcttgagcccaggagtttgaggctgcggtgagctaggatcccaccactgcactttggcctgggcaacagagtaagaccccatgtc

SEQ ID NO: 404980 - DNA, 677 bp, Homo sapiens
acactgtaaatgttagtcatggaggatgtgtaccaacatggaagagtgtttacaatgtatctttagagaaaagatggactatccaagtatgcatactggaattatcattagattaccatacatctgggtgaggagcagaacagagacataagtaacagcaaccgtgaacctcagaggcagccaagggctggagtgcaatggcaccatcgcggctcactgcaacctccacctcctgggttcaagcgattctcctgcctcagcctcccgagtagctgggattacaggtgcccaccaccacgcccagctaatttgtgtatttttagtagagacgggtttcaccatgctggcctcgaactcctgacttcaggtgatccacctgcctcggcctcccaaagtgccgggattacaggggaagccagccaccatgtcataaggacaaagcagccctgaggagaaccaatcccttggggaggaactcggcccccagtcagcagccaataccaacttgcccatgtgtgagttagtcaccttgaaagtggatctgctgtcccagccaagccttcagatgagaccacagctctggccaacacctgactgcagcctcatgagagacccagagaaccatcctgttgagtctctcttgaattcttggcccatagaaattgctagtgatagta

SEQ ID NO: 404981 - DNA, 1160 bp, Homo sapiens
  misc_feature (1)..(1): n is a, c, g, or t
  misc_feature (15)..(15): n is a, c, g, or t
nccgctctagagtancccacctcctaccccacgattcactacctggtctttaccagaaaaagtttgccgtcacctgatctagagccaggtttggagcagagatgtgctgacagcttttgagtctcttacatgcctccaccttctttctttgcatcaaaaggacatgaaagtttccatgtcagtaatagcgagtggcttgccctcccacagctaaaaattatatataaactccagacaaagctttaaaaaaacaactgtttgaaggcactgcagagcaaccaaatgcagtcagggactgcaaaggggagctttcttgtgtaagatccacatttttacagcttttccccagtgggtatttcccagttcgagtggcacagggtagctagtacttaagcagaaagcttgtgttgagtgcagagtttaggactgctagagcagccagaaaaagaggaggcaaatcgcagaaaagggattcaacaaggagggaccccctaaaatctgtttataaattccctgaagtttttttgacccccaaattgtgaattcacaagagagacattataaaatgcaacagaaaccagtagctggcaagggtgacaagacagcagagatttcagctgctcctcattacagcagggctagacttcaaagtttgaatccaatcctgctgtgttacaggggatcactaaacaccttgggcattccgatgaaacttcagaagagccatgccttgggagtagaaaccgtgtcctaggactaagggcaaatccaaaaacccaagtagaccaaccaatctcaggatgagtcaccagtaacttaatactcttcagagaagaaaaaaaccaagcgtctacagtgcatcatccacactgtccagtggacagtcagcactactacacatatgaagaaacaggaaggtgtgacccagtgagtagaagcaaaccctaaagtgacccttttcttggaatttgcagacacagaatttaaagcacatattttacatatgttcagagatttaaagaaaactaggccaggcacagtggctcatgcctttaatcccagcactttggaaggccgagacaggcatattgcttgagtcgaggagttccaaaccagcatggacaacatggcaaaagcccatctcttaagggaaaaaaaaa

SEQ ID NO: 404982 - DNA, 998 bp, Homo sapiens
aagccgtcagcactccttgttctgtttttctttcttcctttccttttctctgagagtttaatactttcaaaggaaaagctttaaaaaaacaactgtttgaaggcactgcagagcaaccaaatgcagtcagggactgcaaaggggagctttcttgtgtaagatccacatttttacagcttttccccagtgggtatttcccagttcgagtggcacagggtagctagtacttaagcagaaagcttgtgttgagtgcagagtttaggactgctagagcagccagaaaaagaggaggcaaatcgcagaaaagggattcaacaaggagggaccccctaaaatctgtttataaattccctgaagtttttttgacccccaaattgtgaattcacaagagagacattataaaatgcaacagaaaccagtagctggcaagggtgacaagacagcagagatttcagctgctcctcattacagcagggctagacttcaaagtttgaatccaatcctgctgtgttacaggggatcactaaacaccttgggcattccgatgaaacttcagaagagccatgccttgggagtagaaaccgtgtcctaggactaagggcaaatccaaaaacccaagtagaccaaccaatctcaggatgagtcaccagtaacttaatactcttcagagaagaaaaaaaccaagcgtctacagtgcatcatccacactgtccagtggacagtcagcactactacacatatgaagaaacaggaaggtgtgacccagtgagtagaagcaaaccctaaagtgacccttttcttggaatttgcagacacagaatttaaagcacatattttacatatgttcagagatttaaagaaaactaggccaggcacagtggctcatgcctttaatcccagcactttggaaggccgagacaggcatattgcttgagtcgaggagttccaaaccagcatggacaacatggcaaaagcccatctcttaagggaaaaaaaaa

SEQ ID NO: 404983 - DNA, 1585 bp, Homo sapiens
gacaagaagacctgactccatgagtagaagcaaacccgaaagtgatcccattattagaatttgcagacagaatttacacatatatttttgggccacatccaacctgccaccagtttttgtaaataaagctttcatggaacatagccatgcttgtttgtttattatctatggcagggacgtccagtcttttggcttccctgggccacatcggaagaagaattgtctcaggctgcatataaaatacaccaacgatagctgatgagcttaaaaaaaaaaaatcgcaaaaacagctcagtgttttaagaaagtttatggatttgtgttgggccacattcaaagctgtcctgggccacataacaggccgcaggttagacgagcttggtctgtggctaccttcactctacaatagtagagttgagtagttgcagcagagattatgtgacccataaagcctaaatattcactacctggtctttaccagaaaaagtttgccgtcacctgatctagagccaggtttggagcagagatgtgctgacagcttttgagtctcttacatgcctccaccttctttctttgcatcaaaaggacatgaaagtttccatgtcagtaatagcgagtggcttgccctcccacagctaaaaattatatataaactccagacaaagctttaaaaaaacaactgtttgaaggcactgcagagcaaccaaatgcagtcagggactgcaaaggggagctttcttgtgtaagatccacatttttacagcttttccccagtgggtatttcccagttcgagtggcacagggtagctagtacttaagcagaaagcttgtgttgagtgcagagtttaggactgctagagcagccagaaaaagaggaggcaaatcgcagaaaagggattcaacaaggagggaccccctaaaatctgtttataaattccctgaagtttttttgacccccaaattgtgaattcacaagagagacattataaaatgcaacagaaaccagtagctggcaagggtgacaagacagcagagatttcagctgctcctcattacagcagggctagacttcaaagtttgaatccaatcctgctgtgttacaggggatcactaaacaccttgggcattccgatgaaacttcagaagagccatgccttgggagtagaaaccgtgtcctaggactaagggcaaatccaaaaacccaagtagaccaaccaatctcaggatgagtcaccagtaacttaatactcttcagagaagaaaaaaaccaagcgtctacagtgcatcatccacactgtccagtggacagtcagcactactacacatatgaagaaacaggaaggtgtgacccagtgagtagaagcaaaccctaaagtgacccttttcttggaatttgcagacacagaatttaaagcacatattttacatatgttcagagatttaaagaaaactaggccaggcacagtggctcatgcctttaatcccagcactttggaaggccgagacaggcatattgcttgagtcgaggagttccaaaccagcatggacaacatggcaaaagcccatctcttaagggaaaaaaaaa

SEQ ID NO: 404984 - DNA, 511 bp, Homo sapiens
ttagttccttccacacacccactgtgtccctagctgttccactagctgttccctctgcctggaatagtcttctcccttttcttcaaaaggctggctctttcttgacattcagatctcaccaccacaaacaaatgagatttcttcagaggccttccctgatctaatcaatcaattagccaccccactatttcaaggtcaacctgtttcgattatctgcatagcacttaattgaggtatatcgttattattcatatactatctcttcattagaatgtaaggtcaatgattagggacctttaccactgtattctggtgcctaaaacagtgcctggcccataacagaagttcataaagatgttgagtgaaaattttatgaataaatgaatagccaggcacggtggctcatgcctgtaatcctagcactttcagaggccaaggtgggcagatcacttgaggccaggagtttgagaccagcctggccaacatggcaaaaccccgtctctactaaaaa

SEQ ID NO: 404985 - DNA, 943 bp, Homo sapiens
agcgggctgccgccgcggcggccgctgctgctgctgcttctgccgccgctgccgccgccgctgcctggatatagtgcggcaagagcggagcttgcagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgtaacttattgaatggcaacc

SEQ ID NO: 404986 - DNA, 6381 bp, Homo sapiens
agcgggctgccgccgcggcggccgctgctgctgctgcttctgccgccgctgccgccgccgctgcctggatatagtgcggcaagagcggagcttgcagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggatgaagttcagattaccagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcggaaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgtccatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagataatcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggggtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctgggatatatttttaacaataagtttgttagcattatttatttatctttagagagaaaatatttgcatctgtttatttaccctttggaagcattaatacttagtcactcacattgaaattgcatatggatgtatcaacataggctaaaattaaattatggatgtcgcagaaatga

SEQ ID NO: 404987 - DNA, 5065 bp, Homo sapiens
gcatgcaaaactcctcatagcgcctgtgaaatgttgaaggaaggggattgctgacaatacaagccagaaagagcttttgcctgaaatactcagataattcaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggatgaagttcagattaccagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgttgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcggaaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgtccatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagataatcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggggtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctgggatatatttttaacaataagtttgttagcattatttatttatctttagagagaaaatatttgcatctgtttatttaccctttggaagcattaatacttagtcactcacattgaaattgcatatggatgtatcaacataggctaaaattaaattatggatgtcgcagaaatga

SEQ ID NO: 404988 - DNA, 2033 bp, Homo sapiens
agcgggctgccgccgcggcggccgctgctgctgctgcttctgccgccgctgccgccgccgctgcctggatatagtgcggcaagagcggagcttgcagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaagtgagtcaacaatttcaaaatgtgttggttaattcaagctgatcttcagtatacctgtatgattggctttttcggtttcctccaacattttcttttcttttaataaaatggtgttgggaagata

SEQ ID NO: 404989 - DNA, 6872 bp, Homo sapiens
agcgggctgccgccgcggcggccgctgctgctgctgcttctgccgccgctgccgccgccgctgcctggatatagtgcggcaagagcggagcttgcagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggatgaagttcagattaccagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgttgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcggaaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgtccatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagataatcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggggtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctgggatatatttttaacaataagtttgttagcattatttatttatctttagagagaaaatatttgcatctgtttatttaccctttggaagcattaatacttagtcactcacattgaaattgcatatggatgtatcaacataggctaaaattaaattatggatgtcgcagaaatga

SEQ ID NO: 404990 - DNA, 1540 bp, Homo sapiens
agcgggctgccgccgcggcggccgctgctgctgctgcttctgccgccgctgccgccgccgctgcctggatatagtgcggcaagagcggagcttgcagcggactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatgtaagttactttcctttgtattttcattaaaataactttgcatgctttgaaacatatgatttttcaataaagaccaaaatatatatgtag

SEQ ID NO: 404991 - DNA, 699 bp, Homo sapiens
ttcattttgaaccctgtatatcttagtgttccttcattaccacattttaactacttttgatataacagatatctttactgctttagggaagcaaatttaatttttatgttactgttctgagcatgttgttccttacatgcccactttcctaagtagaaatatattaacagctagaagaaatcttttggctttctgttttgtaagttagagtataccgtactgtatgcagaggattaggatgttaaaatatttatttccctgttaaatggcttaaatcatgaacaaactgaatatatagcattgctttttttaaaaagtgagtatcccagttaagtgacctaaggattataggactaaatgtagaaaaaaattcagctttagattagatgttttttcccttgtcacagataatgctgtatctaggtgaacagtcaaggaaatgagagggcattgttcttgtcttgccagattcatcctttgcaatcaaataaagtttgttttgtttttaaaattgtggtacaatatagataacataaaatttactctgttgaccttttttaaaaatatttttattatggtaaaatacagtcatttgttgcttaatgacaggaatatgttctgggaaatgcatcattaggtaattttgtcaagcaaacatcatagagtatacttacactaacctggacagtatagcctact

SEQ ID NO: 404992 - DNA, 317 bp, Homo sapiens
cattgagaccagcctgagcaacattgtgaaactccgtctctacaaagaatacaaaaattagccagatgtggtggcacatgcctgcagttccatctacttgggaggctgaggtgaaagtctcctttgagtttgggttgcagaagttgtagtgagctgagatcatacaactgcacttcagcctgagcaacaaagcaagaacctgtctcaaaaaaaaaaagaaaagaaatataattcatttttatatgttgatcttgtatcccgcaaccttactgaacccttttactggttttactgtttcttctaccactctttttact

SEQ ID NO: 404993 - DNA, 359 bp, Homo sapiens
taattttcctttctcccttcttctttccttccttcagactcttcctccatcttacccatgatttattatgtatctagatttttaaaaatcccactcagtatattcgcttagctttaaaaatgcgttcaaccttgactggcgtagataaggccagcaacatgcccagatgttttctggaatcagagggctgagggtcttctgaatgtttcaggaagggcaactgtagagaagcaaagagcccttaaatacttcagagaagtttgggtaatacacttccccacagcctgtatctcacagctgatagcactaatgtccttagcattcaggccctaagattcccaagagtgtcactttttact

SEQ ID NO: 404994 - DNA, 345 bp, Homo sapiens
agtgtttataaacatatatatgaatagataaatatatgactatacacatacatatatgtatatatgtaactttttgcaacatatatttagtttattcagttcaaaatacaatagaatattagtaaatatatttgtgcttttagtattttatttaagttctgttattttattttttatgactttaatgttgtataataaaagtatcaaatatagtcatattaaacaaacaaaaacccaggaaactatggtataagttggggttaatcaaaacgccatagtcactggtgaatattagctatttttctccctaaactaaaatatcatgaagaaccatctattactatt

SEQ ID NO: 404995 - DNA, 419 bp, Homo sapiens
aaaatgtgtagtatccacctggcaggactatttaaatgttaaatgaaataataatattctatattatgttatatataaaattatatatattctatattatattatataaaagttggttgtccaacataagcatctcctgctttaggaaaagaggaatataatattcatctaataaaatggaaagtcctaaataaagtatgtttactttgttagcttctctaataaaatctcaaatccagaataatatcttggtccatacatcaagtcggtgaaataataccatagaatcagaaaatagaaaatggtaaccagtgctccattagggaagaattctacatttgcgatcacagagtcgcttctaattaattggttttgactttagacatattgtttcactcttctggcctcagattctacat

SEQ ID NO: 404996 - DNA, 510 bp, Homo sapiens
aatctaatttcataaaattttaagtctgcagcaggctccagtttagtctccaaaagcacactccccctgcaaagaggaaactcaaagaagaaaagagagttgtctttctgcacaaggaacatgttgtctatacccaaaggtgttcaaggaacaccctgaatctacccaggtgctgaagctcctgctagagggatttggcttttaaaaatgtcataaccacctcatatggtttggctctgtgttcccacccaaatttcatctagaattgtaatccccatgtgttgagggaggacctgatgggaggtgattggatcaaggcagcagtttccctcatgctgttctcgtgatagtgagggagttctcatgagatctgatggttttaaaagcaggggttttccctgtgtgctctctctctcctgccaccatgtatgccgtactttgcttccccttcgccttctgccatgagtgtaagtttcctgaggcctccccagccatgcacaactgtgagtc

SEQ ID NO: 404997 - DNA, 442 bp, Homo sapiens
tttgggaggaggtagcctataagagtaaaggattttgtttaccacccactggagtccagtgagcagcacaacagagtgtgggagagaggtggccaccgtgggaagatgagtcactggggcctgggggtggagggaatgcagagcagtagcggaaactttactatgttccagacagcaggctagacgtggaggatacagagatgaataagacgaagataagccacccatttaggattcgtctacaccaaatcctggtggctgattggctggtttggctggtctgatccatgtacatcttgagagcttccgagagccagaggcaattgcagtaagacaggcacagggtatcactacagatttcggggtgtgtgggggagctaaaaaatgcactttttagctttattttctttcctctgattccttctgcaaagcaaaaaatgaa

SEQ ID NO: 404998 - DNA, 459 bp, Homo sapiens
tggccagccctttccctacaggaaaccccaacaccctggtgcatcctgtgaactccctgtttctatctccctcagcactgaacagtctgctttcccctggccatcagcttcttactgcctaggagctcactctggtctacgccaagggcaaatgtgtctgctaaagttaagggcgatttccaagcttcttcggcagagaccccagaattctagtaatgagggagacaggttatgccaagcctgcttctcccaggatgcactgggagcctgggaaccaggagggagggaggaggctcagctgaggagctcaggatttaattctatgcatcattaagtagtcctctgaaagtggtgtccccctatacatcatccatgcttagtaaacagcacgctgacattacattagtggctggaaatgaattttcttttttatagggaaattgagaatccgccaagaag

SEQ ID NO: 404999 - DNA, 442 bp, Homo sapiens
gatgtatacctggaaatggaattgctggtttatatggtaattatgtttaattttttaacttgcaactttttaaatgtgagagatataaaggaagagcagtgggtagagggaacatgagtggtagtagttattactatggtggtagtatggctgaaaagttctggtcgggcgcggtggctcacgcctgtaatcccagcactttggaaggccgaggcgggcagatcacgaggtcaggagatcgagaccatcctggctaacacggtgaaaccccgtctctactaaaaatacaaaaaattagccgggcgaggtggcgggcgcctgtagtcccagctactcgggaggctaaggcaggagaatggcgtgaaccccagggggcggagcctgcagtgagccgagattgcgccactgcactccagcctgggcgacagcgagactctgtctc

SEQ ID NO: 405000 - DNA, 466 bp, Homo sapiens
agttacatgagactaaatgaactcatgacattttatttgaatcattgctggttttgttttccagatttaaggaaaattttcttttttctcttagactacctattgcttacagcagcttggtagattactcctttataaacaaaatacaattactttttctccctacttgacccgtccagaattcagaagctattagtgactatccttttttcatggcaataaagttatttatgtaagttcaataagaatctgttctcttcgtaacagaacataattggaagcattggttttataaccaaggttttgactggaacgtcgtacttgagaatgtgtatagatcagatatgaccaagcgatgcagaatttttgttccttagttaagctaaatctggattcttctgccacgaccaggaaaaattaggcatgtggacactctgaagggtgaggacagtggaatttattgggc

SEQ ID NO: 405001 - DNA, 415 bp, Homo sapiens
gttacatagaaggtgtttctgtggaacgctgatagacatacacacatatttccatatgcttactttttgccatttaaataaaacaataaatttttgaaactcttcggtttggaagaagtttatttaaatcacccaaatggttgttggatttactaacccatatgcaattaagaaagaataagaagagaaaatggtgaatcaatttgagtcagtaaaatatatactacatatattttcattttcattaactatataaagcccaaatacttcaaatttgtttttacattaaaatagaattcttctgttcatcctgttttaaaatcagtcccattcaacagtatttgccagcatattaattagaggtttagtagaaagagaatgaattttagggaaaaacaaaacacggttttctggt

SEQ ID NO: 405002 - DNA, 256 bp, Homo sapiens
caagcacacaagataagctgacaagaggagcaagctaaagttcaagggcctgtgtgaaagagagatgcctgactaatgttttgtcaagataaagcagagggttggtgacagacaatagaggccaggacacttaagtaagaaggtctacctttcctgttttaaagtcatggttgcatctactttcataagaacttattgtgtaatgtttctgtcagtaacctgggaataaagagtggagattctcctgcactacaga

SEQ ID NO: 405003 - DNA, 298 bp, Homo sapiens
tacatgacatgcttttctgtcttctagtttctactgattcatcagaacggggcattgttctgtgatccttcctgcagtttcaaaacagatctacattccatagcttcctcatttcaaatggccaatttatcgctaacttcaaaaacgtgctctgtgtcactttttaaaacaaatcagcaagtcacatcttacatggatggcggcaggcaaaaagagagctcctccttgccttccgccatgattgtgaggcctccccagccatgtggaactgtataagtccattaaacctcttttgaaa

SEQ ID NO: 405004 - DNA, 798 bp, Homo sapiens
tttcactggcagctaatcagtagtcagttcccttgaacttataaagccttagttttacactttgttaggacgagtctttcagatttttcccttgatcttaggcagatccctcagtcctgggacacagtctctactcctagcatgaactgtttgtcaaagctcatgtcactgccctgtactggcaatgaagaataatcaaattctattccaaactgtaggcaaagacaacaactattaatctctactgatcaacttgactctcagccacaggtggaaaaccagtaataaaaaagggttgtctaaaggctttgagatctacccattctcctaaatatttcaaattttatttctggccagattggaccagaaggctgaatccttaggtggtatggctttgcccctatagacttccttgtattgagttgcatgttggcatctgccctcatcatatagtaaaggatgtgataagaagtcgtcagtggaaccatcctaatctcagttttatttttcataagaatgccagtgagcattccatcctacagggtcccctgtaggagaaggagccactggaagaatttctctcagattttagtgccagaaaaagctctgcttctcctgagcaactgataagtttctatctcattaatgtttggctgctgctaagctcagaagcaaagtcagtgtttaggaactcttgtaattttgagggctatcttttgctttaattccctttgtttatttaattatgtcatatttatttccatcagacccttaactgctttttctatagcaaagcca

SEQ ID NO: 405005 - DNA, 398 bp, Homo sapiens
gcagttccctgtttgcacagaaaggcatggaccagatctgtttgtatctatatagtcgctttctcaacagcagtctatgccaggggattccatcccattttctgtcaagctaaattagattttgattgttaagagtaaacatattttctctgcctagaatttacccctgagcatcttctgtataaagctaggtctctaagctctgagatataggggaacagaaaaaaattctgtctgaaacatccaagtgttaatatttattttttatttttgtttaaatcatgcacttagtttgcaagataacattttagatgctgacagtaccaaaagccaagtttctagtctcttaacagtctatggaaccttgttttttgattaaaagaatgttctacatggct

SEQ ID NO: 405006 - DNA, 181 bp, Homo sapiens
ggcctgcactgttagtcccagctacttgggaggctgagatgggaggatcgcttgagcccagttcaaggttgcagtgagctgtgaacagataaccagaacccacggtagacgtgtatgagtgtggcctggagtgtgcagagccgcggaggcagtgccgaggcaggcccttcctgtaaggcca

SEQ ID NO: 405007 - DNA, 887 bp, Homo sapiens
ggcacgaggccttttcacgcgcgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaaggcaagatgctgtctttctgtaattcactcacttgaagcccaggacttttggtggatgttatgatttttgttggcttttcaagataccctggttttgacgtggaagagttagaaaaaagtctcattcaaagcctaagtagtctttgtattttgaaggccatgctgcaatgcaaatcacctcagaggcgtagtaaatatctatatacacatacatgtataaaaatatttagtgaaatggatcccttgtaagaaaaaa

SEQ ID NO: 405008 - DNA, 1680 bp, Homo sapiens
ggcacgaggccttttcacgcgcgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaattttt

SEQ ID NO: 405009 - DNA, 2117 bp, Homo sapiens
ggcacgaggccttttcacgcgcgtcgcgagctaacggactcggcggcggcggcggcggcggcctgcgccccacccgcaccccatctggaccgcatcgctgaatgtgcccggacctgcgccttctgggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgac

SEQ ID NO: 405010 - DNA, 2323 bp, Homo sapiens
aaactttgagcggaccgggacagaaaaaaaaatctctctttgtcttgagggggctgttgagtggtcgcggacctgggctctgtgcgttgggaaagggaagtggaggtgagcctcgggcttcccgccctgtagctgggcccgccccagttgcagcgctcagccccaccccggctgggccaccgccctgcacagtctcagggatgagcagccgcccaagctgcagggcctcgggtcttcggcgcctctgaccctcgcaggttgctgcctttcggtgcagaaccgtatgtatgtcacacattggatgtgagacctgagaaaccgtgttttaacaggtctctgaaagaagatgaatttggctgagatttgtgataatgcaaagaaaggaagagaatatgcccttcttggaaattacgactcatcaatggtatattaccagggggtgatgcagcagattcagagacattgccagtcagtcagagatccagctatcaaaggcaaatggcaacaggttcggcaggaattattggaggaatatgaacaagttaaaagtattgtcagcactttagaaagttttaaaattgacaagcctccagatttccctgtgtcctgtcaagatgaaccatttagagatcctgctgtttggccaccccctgttcctgcagaacacagagctccacctcagatcaggcgtcccaatcgagaagtaagacctctgaggaaagaaatggcaggagtaggagcccggggacctgtaggccgagcacatcctatatcaaagagtgaaaagccttctacaagtagggacaaggactatagagcaagagggagagatgacaagggaaggaagaatatgcaagatggtgcaagtgatggtgaaatgccaaaatttgatggtgctggttatgataaggatctggtggaagcccttgaaagagacattgtatccaggaatcctagcattcattgggatgacatagcagatctggaagaagctaagaagttgctaagggaagctgttgttcttccaatgtggatgcctgactttttcaaagggattagaaggccatggaagggtgtactgatggttggacccccaggcactggtaaaactatgctagctaaagctgttgccactgaatgtggtacaacattcttcaacgtttcgtcttctacactgacatctaaatacagaggtgaatctgagaagttagttcgtctgttgtttgagatggctagattttatgcccctaccacgatcttcattgatgagatagattctatctgcagtcgaagaggaacctctgatgaacatgaggcaagtcgcagggtcaagtctgaactgctcattcagatggatggagttggaggagctttagaaaatgatgatccttccaaaatggttatggtattggctgctactaatttcccgtgggacattgatgaagctttgcgaagaaggttagaaaaaaggatatatatacctctcccaacagcaaaaggaagagctgagcttctgaagatcaaccttcgtgaggtcgaattagatcctgatattcaactggaagatatagccgagaagattgagggctattctggtgctgacatcactaatgtttgcagggatgcctctttaatggcaatgagacggcgtatcaatggcttaagtccagaagaaatccgtgcactttctaaagaggaacttcagatgcctgttaccaaaggagactttgaattggccctaaagaaaattgctaagtctgtctctgctgcagacttggagaagtatgaaaaatggatggttgaatttggatctgcttgaatttctgtcagctctttaatttctggtatttttgttgataaaatacgaagaaattcctgcaatttttaaaaaacaagtttggaatttttttcagtggagtggttttcgcttaaaggaaaaaaaaatctaaaactgcgaagaatactaaatgtagttgagaaataattgatggcgagagtttgctagtctccctccccggctttgtgctggtattccacgtattcctgcattaatattgcacacccaaaccagtctatcagggaggctgaagcaagggcgcagtgtgatattttaggaatacagaagatttagaaatacccctatttctcatttgcagtttttttttccaattctgtgctctgtcaacatgagggacctatctatgtatgttgacttttaacatcaaaattggatttgtgtcaaacattcattgttaagagaagaatgacagtatattttggaggaaataatgaatttactaattaaacctttagaatttatgac

SEQ ID NO: 405011 - DNA, 652 bp, Homo sapiens
gcagtgtcctgtaagattcacattcagtgtgtccacttccctgcaacaccaggaatttctcattttccccacttttaaaataattttcacccctctttgaaaatttaatgtaagatagaaatggaaaaatgcctaagcagagttctttctgaattttctgtccatctagaaacagaaattgttcttagcatgtgaaagggaaaaataatctacatactttaatttcatggtattactttcagtcatagattgggaacccttgaacttcttattatgtcatcaaattgaacttctgaactttttgtgagagcctataaacctgaaagtgaaagctgcatgaaattgttttccgaggcctccctcagcgtctgcgtagtagtagcgggctcttgcttacagaacaacagtgcaatggcatgacaatatcatgtaaaatgtacagttctaaaagtgtttcccggggctttcagtaagatactgattattattagttttttatttttttattttttttttttttggttagcctcatttttctgtctttaaaagttagaatataatctatccttttgtaatttggcagaacacatttgggaattgcataaatcgattcagaatgaaatccataaagggctttgtgctcctcagagat

SEQ ID NO: 405012 - DNA, 1599 bp, Homo sapiens
tttcctccctgcaggtagtgccagcagggcaccaggataagcgttctggtggtgctttctgcccctgtctggggaaggctgctgggcagctcattctgtgactgtagctccagatgagtgctccctggcagcagccctgctccctgccttccctgcttctgatcgtcttttctttgggttggctcaggatgccgtgaggatggagagagtggacggatgtctcaaaagtcagctctaaagtcggagtcagaacaggggctgccgatgctctgtctcccagtctacctggagtgattcaacatagaaatcaataaaacaaatgccaccatggctgagtgagacctttcatttttcttcccaggtgttggagaaggcttctggtgaaggatttggcaaaaccgccgagggtccttcctggtgctgctcctgagggaatgcttccgagacctgagctggctggcactcatccatagcgtccgtggggaggcggggctgctggtgacgagtatcgtcccgaagaccccgtttttctgggccatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcggtaactgctcctgcatctaacttggctgttgtccctccactcctgcccttggggtgtctgcagcaggctgctgcctagggcctggacacagtatttacctggcattcttttagatcaaacgaactggttatctgaggggttgggtgaactggctcgggtgggccttccttcccaccaaggctttgtctttctcttccagttgcacatcctaaagtttgaagagtctaaataacggggcttccctcagcatgttccctctcctgtttgccacggatccagaggccacctgccctgtcttctcgtacccctttcactcttgaggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatgaaaaaaa

SEQ ID NO: 405013 - DNA, 1257 bp, Homo sapiens
tttcctccctgcaggtagtgccagcagggcaccaggataagcgttctggtggtgctttctgcccctgtctggggaaggctgctgggcagctcattctgtgactgtagctccagatgagtgctccctggcagcagccctgctccctgccttccctgcttctgatcgtcttttctttgggttggctcaggatgccgtgaggatggagagagtggacggatgtctcaaaagtcagctctaaagtcggagtcagaacaggggctgccgatgctctgtctcccagtctacctggagtgattcaacatagaaatcaataaaacaaatgccaccatggctgagtgagacctttcatttttcttcccaggtgttggagaaggcttctggtgaaggatttggcaaaaccgccgagggtccttcctggtgctgctcctgagggaatgcttccgagacctgagctggctggcactcatccatagcgtccgtggggaggcggggctgctggtgacgagtatcgtcccgaagaccccgtttttctgggccatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcggtaactgctcctgcatctaacttggctgttgtccctccactcctgcccttggggtgtctgcagcaggctgctgcctagggcctggacacagtatttacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatgaaaaaaa

SEQ ID NO: 405014 - DNA, 1278 bp, Homo sapiens
tttcctccctgcaggtagtgccagcagggcaccaggataagcgttctggtggtgctttctgcccctgtctggggaaggctgctgggcagctcattctgtgactgtagctccagatgagtgctccctggcagcagccctgctccctgccttccctgcttctgatcgtcttttctttgggttggctcaggatgccgtgaggatggagagagtggacggatgtctcaaaagtcagctctaaagtcggagtcagaacaggggctgccgatgctctgtctcccagtctacctggagtgattcaacatagaaatcaataaaacaaatgccaccatggctgagtgagacctttcatttttcttcccaggtgttggagaaggcttctggtgaaggatttggcaaaaccgccgagggtccttcctggtgctgctcctgagggaatgcttccgagacctgagctggctggcactcatccatagcgtccgtggggaggcggggctgctggtgacgagtatcgtcccgaagaccccgtttttctgggccatgcacgtcactgaggctctgcaccagaacatgcaggctctgtttagcaccctggctcaggcggaggagcagcagccctacctggagggctccaccgttatgcgcgggactcgctgtctggcagagtaccacctgggggattatggacacgcctggaacaggtgttgggtgctggacagggtggacacctgggctgtggtcatgttcattgattttggacagttggccaccatccctgtgcagtctctgcgcagcctagacagcgacgacttctggaccatcccacccctgactcagccattcatgctggagaaagacattttgagttcgtatgaggttgtccatcgaatcctcaaagggaaaatcactggtgctttgaactcggcggcctgggaggtgaaaaaggccagactgtgcccaggattgattcaattttgcttttactcccagcttccctctcaaaagagagtgaagtctcatttgtcatgtgtcttcagttccccaacttggcatgaacatttgaaccaaacataggaaactaccattaggttgaaagcctgaggcagctgggatggtctttcttgtgtctcttctttgcaccccagagcatgatataagtggtcctaacagattctggataatggagaagccctctgctggttttcctggcattccatgtagaataggtagagaatatttaaccaatgagcaaataaatgttggcatgtttcatgaaaaaaa

SEQ ID NO: 405015 - DNA, 389 bp, Homo sapiens
atggggagtggggggaggaaagctttaatctgtggggagaagagcaaaaatgccatcacacttaggacatttgttaaagcccactgcggctggggagaagagaacaagaaataaacctggacccctaagggaagagcaggaatacgtgcagagttcagaatatcactgggggtagggtaggataactgataaggccacactcccaagatacagggacacagtgactgcctaagactgagatctgaacaaaacaacagagaaccccctgccccctcagtccccactacctggctaaacagcactgagtcacaagcagcatgcaagagacagacctctctgaggcacagaacaaagggaagacttgaggctgaggatagagcaatcattga

SEQ ID NO: 405016 - DNA, 755 bp, Homo sapiens
  misc_feature (740)..(741): n is a, c, g, or t
tgtctttccttctactgcacactgagctcctgaaggcactggggcttgctcccatttgtaccctggagcacacagtaggtgcttactaagtgactgtggagcagaacttctaatatttttgaaacacagatttggaaacatcttcccagaaaacagactacaacaaatcatttccctggtatgaaggaatgaagttttttgtttctttcatagtcctaaaaaaatcccccaagagctcaccagcatgaaagcactagctctgaatatgatatggaggaacaatgatttgaagaccttcgaaaggcaagcaacttgacacggggcatctttctagatcattgtttggaagagaaccatcaggacgatcccaggggtcctgtgaaacgctgttggcctgggcaaggagggaactggtgctcatcactggccctcttcagaaacaatctgctccgtccaagtgcaatatgagtatttccagctgaccatggggaaacttgttttctagtttatcccagctacattatcaagaaaatagtcaatggagtcaacaaatgcaaacctctggaaaacatttcagagactggcttgttgctacaacaagaacggtgatatcataatcaccattgtggagcaggtgccaggtagcattgctaacctcttcagaataattgacatttttctaacatgcagagtggccataacaaccacttcagctacacccccttctgtcgtcttgtcgnngcggccgcgaattt

SEQ ID NO: 405017 - DNA, 436 bp, Homo sapiens
agaaatggagtctccctatgttgcccaggctggtcttgaactcttggcctcaagtgattctcccacctcggcctcccaaagtgctgggattacaggtgtcagccacagtgcccagcctcttttggcttttttgaatgatatgacacatctccaaaacatagcacagggtggatccaagagctcctggggtaagagctgcctggacccacaggtccactctcatgggctctgattagagctgcactgccccattccctcccaataccaggagccctcatttcagcctcagctcccccaactttgacacagtattttactcaaggtctctgttatgaattgaattgcgccccccaagaagtccaaaaagttgtgttgaagtcctagccctggccccaacctatgaatatagcctcttgaaagtcgaatctttgcggat

SEQ ID NO: 405018 - DNA, 359 bp, Homo sapiens
ctcctcgggccacctcatcactccctgcccatgtgcctgtaacccccagcccagcccagggtagttgggggtttccacgacagacaggacgctgcccctgccgccagcctgcttcctccctggcccctgccagctgagggctggagcacagtccccccacccccgccagcaccccacaaggctcagatggggccgtgggccgtgcgacttgtcggtctgtttgccatggtcctgggtgggtggcagggatcaagttctaagcttgggagcagaggggaaggcaggtggtggcatagccctgggagcttcaattgtgtgtgtttgtacattaaataataacaacaaaaaacccatccttg

SEQ ID NO: 405019 - DNA, 380 bp, Homo sapiens
ggaaatttctgagacttgacatctaggttttttcttctgtggggtttgagctgtcttccttccttagcccaaagaatctttttcctgcactttcttaaagcagttttgggtcattccagaagggttcagagaaggtgtcttcctggtggaagacagttttacttcattcaaggtttttgcctggcaccacagctccaggacctttctgcctgatgatgatttttttttttttttttgagacagtcttgccctgtcgcccaggctggagtgcagtagtgtgatctcagctcactgcaacctccgcctcccaggagaatcgcttgaacccaggaggtggaggttgcagtgagtcgagatcgtgccactgcgctccagcctgg

SEQ ID NO: 405020 - DNA, 343 bp, Homo sapiens
ggaaatttctgagacttgacatctaggttttttcttctgtggggtttgagctgtcttccttccttagcccaaagaatctttttcctgcactttcttaaagcagttttgggtcattccagaagggttcagagaaggtgtcttcctggtggaagacagttttacttcattcaaggtttttgcctggcaccacagctccaggacctttctgcctgatgatgattttttttttttttttttttgaaacagcctgggtgacagagtgagtcttggtctctttaaaaaatagaagcttctcaggggcgggtgcggtggctcacgcctgtagtctcagcacttggggagg

SEQ ID NO: 405021 - DNA, 225 bp, Homo sapiens
tgcggccatcccttttgttccctgctgtgactgactggcaggaacctgggcttgtcaagtcagtctgtagtgcacgccgttagattggttgtcattggccaagccagctccgggcaccctgaggttccctcacagcgaatccaccgaagagcgctcccatccacagccggctctttgaatacttaaagaaatgtaggaaaagcaaaactcacaagacaatccttc

SEQ ID NO: 405022 - DNA, 429 bp, Homo sapiens
agtggtgtgatcttggctcattgcaagctccgcctcctggattcaagccattcttccacctcagcctcccaagtagctgggactacaggcatttgccaccatgcctggctaatttttgtgtgtgtgtgtatttttagtagagatggggtttcaccatattgaccaggctggtcttgaactcctgacctcaggtgatccacccacctcggcctcccaaagtgctgggattacaagtgtgagccaccatgcccggccagtttctaggtcctcctccatcctaggagtctacctttaaatccaggtcagtctattggagtcccttgaaaatggagaagtgaacaaaggttgatcttgactgacttcttccatggaacctccagcatcttgtgctctcttccttggtactcttgcttgcccttctgtgtcctc

SEQ ID NO: 405023 - DNA, 635 bp, Homo sapiens
tgggtcttttgtaacctgaatggtggtagattccaggacagttcagtaggagcccatcctcaaaaggaaaataacagaacttcctgctaatctggtattggggctgagcaattactgcacactaatgagattgaccataattgcatcctgagtttgaggaggaggtcatgctactaaaatgagataaaatcagctccaacgacaaacatcatctctgggggtttccagattctcacttttcatttaatccccagccttagtggaaagcaagagtcggagtcggcattctgggcagggaggcaggtgaggcaggtacacatctcctcttctccccaacgccccatgtttctatttctgaataaaatgaaccatcatggtgctaaggtaaagctaaactagctgagccacctcctgaagaggtcattgcttttgtttttatttaatgagatttctttcccttctgctaccagcatccctattcctttggaaaactgcttcttcataataacataaaggttttggattttttgttttgttttttgggtagcaaaatctgtataacatgaaattttctattttcaccattttaagtgtacaattcagtggcataaattacctttagagtgctgtgcaac

SEQ ID NO: 405024 - DNA, 637 bp, Homo sapiens
  misc_feature (104)..(104): n is a, c, g, or t
tgggaccacaatttaaaatggattaatgttttctcttatgagatggatggacagaaggatctataaacccatccggtttcacctcaaaggtctggaggaatttntgctatacgcgggcattattttaatgaaattggccagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccagacgtgagtg

SEQ ID NO: 405025 - DNA, 345 bp, Homo sapiens
gggaaggctttccagatattgaaggagacttgggtgttgtgatctaaatttttggttactgcaaccatatctgcattagaggtaccacctttgcggttttggataagatccagaagaattctctgtattaccagagaattcttgttcttttccattactttctcccctaaaatggagtctctccaagttgcagtccttgtgatctagactgcatcaaatctgtgctgagctgcctggagctggagaaggggtggaacacaagcaccactgtggtcaccagctctgggaatgtagtaggtcagacctgaagccagcacagcactgggtcttgtccaaggcccactg

SEQ ID NO: 405026 - DNA, 460 bp, Homo sapiens
cggcagagtcgttctccccccaccatccctccttgcctccactcccctcggccttctggatccccgtgggtttggagaggccgatgcttgtggctcttaccaacatcaatttgcagtctccaggatgcaacttcaccctatgctgcgttcataaattaatctcctgggattagattctgtgttttagtaacactcctgaggcattgtatttacacattaataataaaagaaaaaaagtgagacaagttctgacaactttcaataacattcagaaataaagtgcgaggcacggaagtgtccaaagttaattaaaagcatttggtgctgacgggggctgggggtgttgcctgcctagctctgacaggtgctgtttctgaaatgcaattttcctgtctataatgtacctgatgcctgcagaaaaggagaaaccgaaataaactgaactggcagcatgagcttg

SEQ ID NO: 405027 - DNA, 402 bp, Homo sapiens
gtcagattgcttggttgggattgtcacagaccatgtgataatgggattatattgcatatcacagatgcgctggaccctcaagtgtgctggggaactctggttaaagaatagaagtgatccctttgttcatattcactatgctggatgcccttttgagatccctgcaggacgctaaccctctgactgcggcagccttgccctttgatctgaagcttttatcatacattgtcctgctcaggggatttgggtggggcgttactcctatatatcatcacaagaaagggattctctggagactaaatgcaaactggaatatcccctggaggctgtccccctgattgggaaatatgaagagactaggggtgctcagtgtttaaaataaaacttcagagagtagagtct

SEQ ID NO: 405028 - DNA, 289 bp, Homo sapiens
ggctgggactatctcttggctattacccagcactctactttcaaaacatggctctcttatgtcccatttcctctaacttactttcataatgaatagcaacttaatcccctaacactttactcatacatcaattatccaggaatatcttcattttaaacaagaatccccctacttctcctacatctccacatcctcagcaaaggaaccaaagtcgtaatccagaagaagagtttgaaaatggggacgatcttgatttctttcccattgatttccttgaaggcaaatccca

SEQ ID NO: 405029 - DNA, 279 bp, Homo sapiens
agcacatgctacaggcatagctctggctgaggtgcaggccagcagcaacagctccgatgcttcaacccctagcccagggaacttccatatcccgagggtgcacgcctaaaataaaaaacaggcacagggtgacaacagtcacaaaagaaacacacagaagaggagcttcctcttagcccagcgatgaccagctagaaaataaaatgggggaaaatatcccactctcggtagtggccacagagcaccggattcctagacactgaatgagtcatctgcagg

SEQ ID NO: 405030 - DNA, 321 bp, Homo sapiens
atcctcgatcgggaccgaaaaggccctgaacttgtgcagtgacttgccattgagtccgggaggttctggagacctgggtgacggaagaacgcccaaggccgactgctgccctcagttatcggggctccacatggaccaaacccagctggcagtcagagggcaagagcatctcgatgcagcgcatacaggccaattccagggtgcagtgcagcatggaaaaggagaaatgtacctgaagaggcaaatgaaagatatacagcgtcacaggcaatcttgcttctactaccataaaaatagtttacgtttcttagacacttagtc

SEQ ID NO: 405031 - DNA, 342 bp, Homo sapiens
gtgtcaaactcctgacctcaaatgatccacctgcctcagcctcccaaagtgctgggattacatatatgacccaccacacccagccaagagagggttttagaggtaggaacagcagctgcatgatcttcagcagattcagtagagagggaagtgagctgtgggagaggaaggaggatggggggaatggcaagaaaaggagcaccctgcttagaaagggaacggagctgggtgtggtggctcacgcctgtaatccagcactttgggaggccgaggcagtaggatcacttgagcccaggagtttgagaccagccacataacaagactgcatctctatttaaaaaa

SEQ ID NO: 405032 - DNA, 1194 bp, Homo sapiens
cagtttggtgttcgggaggtcacagctgcccaggttgcaagggttttgggaatgatggctcgaactcattcaggattaacagatggcattccattacagagtatttctgctccgggcagtgggatctggagtgatgggaaagataaaagtgatggagcacaggcacacacatggaatgtagaagtcttgattgacgttcttaaagaactgaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccagctctccttcattcaacattcccttataaatccagagatcttctgttttgctgactatccctgtcatactgttgccactgatattctgaaagcaccaccagaggatgacaatcgagaaattgccacatggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcattaatgcaggagtgtttttcacggagctaacagaaaacatcttccactgtgtaagtc

SEQ ID NO: 405033 - DNA, 1046 bp, Homo sapiens
gttctgtcttttaaatttattttttgccattgatttgatagagaaatacagcatttgttctctagtctaccccatgttattttcttacctgttttctcatggtgtttacttcattctctatccccatggttttcatgggctgaggatagagttagatcttcaggctcagttaaagtcaaccagtttcaacctcttggggcaaaaataattcttaaagagagtgctgtggacttcaaacttctaatattaaaacatgacaccaacttggttttgtgcttacaagctggtatcacttattttgaaaattaatctgtatacttggattttcattgataaagcatgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcagggacagtctccctcaattcgccaacttatcatgcatgcaatggcagaatggtacatgagaggggagcagtatgatcaggccaaattgtctcgaatacttgatgtggcccaggacttgaaggccttgtcaatgctgctaaatggtactccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcattaatgcaggagtgtttttcacggagctaacagaaaacatcttccactgtgtaagtc

SEQ ID NO: 405034 - DNA, 436 bp, Homo sapiens
ggcaaaaataattcttaaagagagtgctgtggacttcaaacttctaatattaaaacatgacaccaacttggttttgtgcttacaagctggtatcacttattttgaaaattaatctgtatacttggattttcattgataaagcatgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcaggtaagatgtgaccgtgtgcttaccatttttt

SEQ ID NO: 405035 - DNA, 752 bp, Homo sapiens
ttcttttatagtcacactgcatgtggactaaaataattttttttaaagagaccggggtctcgccatgttgcccaggctggtctcaaactcccgagctcaagtgatctaccagccttggcctcccaaagtgctgggattataggtgtgagccgctgcgcttggctaaaataaatattttaaaatttaacacgattattattttgaaattggaactctaaaagacttttcaaaattcaaaatgatcaggaatgttaaaaacaatgaaaaaaagcacccctaaacctgccctagattccccaggggagagtcaaagatgttttgctttgtatcagcactattgaaataaacatattgtcacctaaaaggaactatttgaagaggactgcacttcactggatgtgtatatcctggtgagttttttattaatgtttattgttttttaaaaaatgtgttaaaatggctgggtgcagtggcttacacctgtaatcctaacacttcgggaggccaaggcaggcggattacttgaggtcaggagttggaaaccatggtcaggagttggccaacatggtgaaaccccatctctactaaaaatacagaaaagttagccgggcatggtggtgcacgcctgtgaccccagctactcaggaggctgaggcaggagaatcgcttgaacctgggaggcagaggttgtggtgagtcaagatcgcaccactgcactccagccttgggctacagagcaagactccaccctc

SEQ ID NO: 405036 - DNA, 899 bp, Homo sapiens
atcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccgagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcgtgagtgcggggcgcgccaagggccgcgggcccaggctcgggacgcacagcccttccctgtccccgagaaggcggcttgccagcgctgcaggacagccggacagccgggtgccccttgcttgcctcattagatacatacaaatggaagcacatttagagtcccta

SEQ ID NO: 405037 - DNA, 3031 bp, Homo sapiens
atcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccgagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaacctaaaaaaaaaat

SEQ ID NO: 405038 - DNA, 1832 bp, Homo sapiens
ctctgccgaattcggcacgaggttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaacctaaaaaaaaaat

SEQ ID NO: 405039 - DNA, 2408 bp, Homo sapiens
agaaggagagtggagaagggaaggaaaaggagagaagagaggaagcgaggagagaaggaagtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaacctaaaaaaaaaat

SEQ ID NO: 405040 - DNA, 2538 bp, Homo sapiens
ggacagcgccgggacagcgccgggacagccccgggacagccccggggaaagcgcggggacggcgtggggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaatctaaagtgctgacttttttccaatatcactttctcttcttaaagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaacctaaaaaaaaaat

SEQ ID NO: 405041 - DNA, 1153 bp, Homo sapiens
atcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctcccaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaaaatcggagacctagttcagtgcaagtgattatgagaggtgagcaccgagcctgcaccaattcactcagagctcaaagcatgtgggtgcaccccgtcagtcccctagtggtgcttcatttccagggcatctgagagctggactctggtttttatcctttctgtatttacacattataagaacaataaatcatgtaatgttggttacatta

SEQ ID NO: 405042 - DNA, 578 bp, Homo sapiens
cgaaggagaagatgggagaagggagagagtgagctctgccgacagaactcggacagcggacgggacagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggccaatttagaagcttagtcacaggattctgaaggcagctgtgcaagttaaagctgttctgaatggcattaatgtatgcagtcattcagccaatggaaatgcgtggaagttttaaccttgatgtgggataaaggcttcgtggaatgagcagtaccctgcacaacccc

SEQ ID NO: 405043 - DNA, 3153 bp, Homo sapiens
atcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccgagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaatctaaagtgctgacttttttccaatatcactttctcttcttaaagcaaagagcaaatcgcctgtaaaatctacggagcggacagcaaagttgaccctaaactccaagcaccaccctgcacccactgtactctaattcactacacaaggagcgcctgcttccggaagcataaatgaagaggctatcacatgctttgttgatcatattttctttggcaaaacactgatcttttattttaagagaattaacgtgaagtgatagaacgttttctaatagcaagatctattttttcccttttctttcggcgactaaaatcatctcactgactgctcaagggttggcctgaatgtcatcaggatagggaatatttactatggataccactaatttcctactaaaggacccagcatcttcaggaagcaaacagagatcaaaaggctacagaacagaagctatcatcagacaaaaccccctttttaggggaagaacaaaactatcaacactgcaagtcaacaaggaggacattactttaaggaataacatgagaaagaaatttttttattttcccctttttttcttggatttttcttctttttcttgattacagttcttgttcaatggtggcaagtgctggttatggccaatctccgtcaatcctaggaggtttatagaactacattttgagtgttctatatttcagtgtattttaattcattttgcaattcctgtgtatgcaaacctgataaattctgtaaattgcttatagtatgtgtgctataacttcaaagtagatgtactgcgaccctcatgcaagctgatttttatcattatatatataaatatatacttaagaatatctgtgtgttgggccaatgaccaactttttttgacgaagcatttgtttttcgttgataattcatacactgcgtgaattttgtaattcattgtttcacttccacaggtttgacagctgcagatggtctctattgtcctctgcttcattctggaaagtgcatattcaaaattgtatcagtctctgatcgatgaattaattttgttatgtctgtgctaagttggaatttactatgttcctttatacatggtgtttattgaggtttgagagtctcttgactgtgaagaatgtacactgtctggttttgacagctatttctgtattattatcattataatcttgtcaaatagaaatgttgcttctagaaaatttgcctaggaggcgaatgtggggaaggtgaagcactcaccataattccctaaattcatgttagaacatttcttgctatggttaaaaatgctgcttcctttgacctttatgaatttctgtacctttgtcattctgttacctttgtcattctgttatttgcgctaattatattttaatgtctcctaattaaaaattaaaatttggttgttggctaaatacaatatgcaaaagatgatggcaggtccccgactaaagaagattaatgtgttcagttttcactggttaagtgaattataattttaaatattccattcttatttatgtctttatgataattcagactattttattttgaacctgttttctactctggcaaagaaagataggcagaactattagtgttccatatacattatggaatagataaagcttgagagataaatgacctaagttttccttccagagagactcttccattttctctcattacaaaaccagaagatcagctatgtggggccatcagctcccagcctaaggtcctataacccgaagcttgaaggcaatcagtacctctgcttttcaaaggtaaatgcattcattttctttgattcagttataagcaagtatatattttcataatattcttgacattacctgagaaataatacttcatgctaaatcttttactgccacttttctcattcatttggtttatcatttcagtttaatgagaaaaattaataaaggttttgattgcactattttattaacctaaaaaaaaaat

SEQ ID NO: 405044 - DNA, 1381 bp, Homo sapiens
atcatcgcagccattagagggaaaagttgcggcgccgcgagcccggcgaagtcctcagcccgccccgcttgcccactccccacttcccgagccggctccgtgtttagggagggcagtgatcacgcaagccggagcggcgggctgacgttggacgagctgccaggtagctgaaagcaggcagccaggcagccgagacacttcccagcgattccagcctgggctccgcaggaagcctcgctgaatcccagccagctggttctaaccttccagaatcgcaatcccttctccccacagccagccctcgccgagcaagcagcaggatgtttgcagtgtcgcgcccagggctctgagactgagcctgccatccactcgcacgcctttctttcagggcttttcggctgttggctacactgatgtgacccccctccctttttggaatgatggggatctttttggtgtatgttggatttgttttcttttccgttttatatgtacaacaagggctttcttctcaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaaaatcggagacctagttcagtgcaagtgattatgagaggtgagcaccgagcctgcaccaattcactcagagctcaaagcatgtgggtgcaccccgtcagtcccctagtggtgcttcatttccagggcatctgagagctggactctggtttttatcctttctgtatttacacattataagaacaataaatcatgtaatgttggttacatta

SEQ ID NO: 405045 - DNA, 215 bp, Homo sapiens
agtgtcattcactggtaacttttattaaacaagtcatccttttccctcactggaattgtcactatttttctacatattttcaaagattgttatttgtttctggattctattctgttcccgtgatctgtcaatcctccttccagtgctatatgggaattggtttattttgatatctgataatgaagatctccaaggaggatttattgtttgacgat

SEQ ID NO: 405046 - DNA, 442 bp, Homo sapiens
caacaccccatctgcccagctatgaattaacatttttaagcttcctttgagattattgcagactttagggaaggagaaaacaagtgtagtcaagacaccatatttaaccagaggtttgtgaatcagactacttctcactgtagattccctttagaaattgcagctgcctttcttttcctcgacaatttctcattcaatatattgtataggcaaccttgataattctcttgaacattttagtgtgttttatctcacttagtcctcataaaatccttttggaatcaacatgtcatatatctttttgtagagtttcccaaaaatggtaagctctggattttaaatgcatagtaaaacagatatttaatatatatgagaatacattctgttcattcagttttacttccatttttttactgtgttgcaaaataaagaggttattgat

SEQ ID NO: 405047 - DNA, 337 bp, Homo sapiens
tcccatctctagcatcacatgagaagatctgtcaccaaacttgaggtgacttccctagtcccatctctagcatcacatgagaagatctgtcaccaaacttgaggtgacttccctagtcccatctctagcatcacatgagaagatctgtcaccaaacttgaggtgacttctccagtcccatctctagcatcacatgagaagatctgtcaccaaacttgaggtgacttctccagtcccatctctagcatcacatgagaagatctgtcaccaaacttgaggtgacttctccagtcccatctctagcatcacatgagaagatctgtcatcaaacttgaggt

SEQ ID NO: 405048 - DNA, 627 bp, Homo sapiens
ccgtcagacactcagacacaccagcggggagagctgcagccactccagctttagctgggttgtgctaagagctttaagtgcattatatcattcaaagctcccaaggagccgctttggggagtcccgtcaacacccgcattctgcagatgaagggactgggacctcaagggcagctgctagggctaaggtgtggttcttctaccggagatgattttgccccaggggacatctggccatatctggaaacacttgtggttgccacaactgggagggggtgttactagcatccagtgggcgaggggaagtagctaaacatccaccctgccacgcacagggaagtcccccacagaaaagaattattgagcccaaacgtcagcaccaaggtcgagaaactctggattaaatcagatgatagtgaatatctcaggcacagtgccgggtgcatagtgcttgctcaataaacattagctaggcaacagctgattcctaattaggcctcaatgtgaagacagaagcagggactgaaaccacacacaaccggtttgaagaataacaacaacttagtctaaaaacatctgctttgaaagcaaacgcttaggaaagggcagttgttcatttcacacttgg

SEQ ID NO: 405049 - DNA, 434 bp, Homo sapiens
tccagcgaggaccaggcgatgctgcaggcgatgctgaggcggttgttccagagcgtgaaggagaaaatcacgggtgccccttccctggagtgtgccgaagagattcttttacatctggaggaaactgatgaaaattttcacaactatgaatttgtgaaatacctcaggcagcatataggcaacactttgggttctatgattgaagaagaaatggaaaaatgcacatctgatcggaatcagggtgaagaatgcggctatgatacagttgtacagcaggtcactaaaagaactcaagaatctaaagagtacaaagaaatgatgcattacctgaagaacattatgatagctgtggtcgagtctatgattaacaagtttgaagaagatgagacacgaaatcaagaaaggcagaaaaaaatccaaaaggagaaaagcca

SEQ ID NO: 405050 - DNA, 208 bp, Homo sapiens
tgccctgcctccctatgatgaaagaaagatagccaagctcactggttcaagacattatctcctactgcaaatgtcaaactgggtcttgttttaaatttggaacttagaagtaaactagaaagaagagaatctgagttttatttctttgataaagaattccaagtactttgaaggaacaccccccaccccaatccaacctccacaggtc

SEQ ID NO: 405051 - DNA, 107 bp, Homo sapiens
cagtctttctgaattttacttatagatgaggcagaggatactaaacatcatataactggattatgctgattctctctagcaactttcaagttacattaaatattagt

SEQ ID NO: 405052 - DNA, 278 bp, Homo sapiens
acaaacaacaacaaaaaacgacacaaaggaagaatccagtggagaagggcaggtgggtggggaaaggttatggatgaaactacaagacaaggatataggattctcactagttctgctggtacagggagctgtggatggggactctgataagctaaatgcacaaaactgggagggcacgatgcagagtttaataaatgcttatgatctacattgccactactgctgttttctggaacataactttctctacaaagatcttcattgtactgtatgtggtt

SEQ ID NO: 405053 - DNA, 328 bp, Homo sapiens
tgggggccagccacagggattggctcctgcttctgggaggtgcctctagactcctggagggaaggccaggggctgcctgagactttcggtaacagcctcagagtggtcgaggattcgacccaagttccactacctttcattagggatgttttgtaaactgtcaagtgctgtacaaatgtccatttgtttctcttttctccttaatgaacttcagagaccagaacagaaaatcctgctgccacaaataccagaaatgctcgataaagaaaacaaatttccttttagacacatagcaaagctcatcaggctgggagtagtggctcatgcc

SEQ ID NO: 405054 - DNA, 216 bp, Homo sapiens
tggactgattactgtaatctaacaggtgagactggaaatcagatagtgcaaggcctccacctttattcttttttttcagaatcatttgggtgattataggtcctttacatttctacccctgaaaaacatactgggattttgattgtgattgcatcgaatatatagatcagtctgggcacaaaccactgtgacagctcagaattgttagtctttttt

SEQ ID NO: 405055 - DNA, 528 bp, Homo sapiens
cataatgaaaaggcaaaattagatcttgttgcatcagtgtggatagatcataggcacagtcaattggatgaagcaagctgcactacagttcatgcaggatgatggctttttttaaatgcacacaacaaaaccatataaaactcttctgaaaatgtctggaatgatgtctacctagtttatcatggtggcaacctctgaagagagatgagatagaatagagtgggagagaaagaagacttcagccttttctgtagtgttctaacaagggtgaatgagcttatatgttattctgtaattgttaaaaaccagtacgagtcacgatgaacatcaagatgagtaagacaggacccctgccttcagagaattcagattatgcagggagcaggaaggaagagaaatagggggagagcggagaaacaaaaggcatgtgctatctcctttcaagttgatttcagcaagcttcacattttgggggcaggcaggggaagaattctagaagagaaacagggtattctagtgagacaagcc

SEQ ID NO: 405056 - DNA, 105 bp, Homo sapiens
ctgcggcgtccagggtggaacggggttgcccctgcacgcattctttttgttctgagcctgcttgtgtgcaccagcttccaaaaataaagcattttccttgtgtga

SEQ ID NO: 405057 - DNA, 637 bp, Homo sapiens
atttgaaaagaagtgatcaggccgggcgcggtggctcacgcctgtaataccagcactttgggaggccaaggcgggcggatcacgaggtcaggagatgaagaccaccctggctaacacggtgaaaccctgtctctactaaaaatacaaaaaaattagccgggcctagtggcgggcgcctgtacccccagctattcgggagcctgaggcaggagaatggcgtgaacccaaagtggagcttgcagtgagccgagatcctgccactgcacttcagcctgggcaacagagtgagactccgtctcaaaaaagaaaaaagaaataagtgaacaaagaattagctcctttcatttttaaggatgtgaagacattaaggaagatttaaatgaagaaaggcatatgaaaatacccagctccgtatcaacttataattaaaaagcagtaactaccattttttgagctcattgtactgtgcaatgtgctaaacacattccagtatttgatttaattctcttaataaccctgcagagcaggtaataggaattccattcaacacatgaggaatttcagagaagccaagtagcaggcctaaggtcacacagcttccaaatggtgatgttgggatttgaattcgatctgtgtg

SEQ ID NO: 405058 - DNA, 1947 bp, Homo sapiens
gcaagaccctcagagtcttgacaccgggcctacactcaagtaacatggtcaacaggagggcgggatggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacaccacgccagtattgcatccatctactgcagctacacatcctgagggcagcaccacccactctggcctgctggcccatcgcaggactagcccaggcacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttatttaaaaac

SEQ ID NO: 405059 - DNA, 505 bp, Homo sapiens
gcaagaccctcagagtcttgacaccgggcctacactcaagtaacatggtcaacaggagggcgggatggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccccagtaacagatgcccgttgctcttgggctggtctcccctgaacacctccaagaggctgcctgccttgccagcacccgtgtcctgagctcctgcagcccagtggctgctgaagttgtgatccctcactcaccctgctagctttgcccttgactcgtcttctctgaacctcagcctcgtgcattgcctggaaccttc

SEQ ID NO: 405060 - DNA, 391 bp, Homo sapiens
atccactggcatttggatttgctgccagagtcctgttcctcccagaaccatcccgccctcctgttgaccatgttacttgagtgtaggcccggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggat

SEQ ID NO: 405061 - DNA, 1851 bp, Homo sapiens
gcaagaccctcagagtcttgacaccgggcctacactcaagtaacatggtcaacaggagggcgggatggtgtcaagaccctcagagtctttgaggaaagagccaagcagagaagaccgctgcgtggagtgtgacaccacatggcatttctcaagcccagcggaccctgtgtcagcaaataccagtaatttaacatctgctcctggcctcctcttcacctgcctgggttcggaactgaggaggaaggatgagaagagactgcaatgcagcaggcaccctctgcagagtgaggccgcccgtccatcactgccagccctgggctgctcaggaggggacgtgaaccactcaaaggaatgtcttaaagaggatctggagtttcccccatgcaaattagggaagaattaggcaagaaaagacatacattacagggaaatccttctgaacaaaatggctgtcttcacctactcttcttgcaagaaaagacatacattacagggaaatccttctgaacaaaatggctatcttcacctactcttcagcaaaaaccgtctccagactttttagtgtcaaaaatgtaaccaactgtctcctgattttttccaatgtgtttggcaagtgctgtggccctgttgtaggtacttctcctgactcttgggggagaagtggttttagggattgatttgggggagcgggtttttgtcccatcccacctcctctcttctttctctgcttgtcgatattgtctgtgtgattcagagaattggggcagttacattgtgtctgttgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgttcaggacctctgggtagaggtttcacagtttgtgaccccataaccaccctcacccgacgtgggttctagctcagtgtgcctaatactgcatggtaacctgggcttgaccctgaagcccctgcctggcaggccacaggacctctcctgcccacttggtgctatctcttccagtgaccacccagcacgggtgagcactggccagcctggagcctgcaatccaggtggaacagactgtcctccatgtcagttccttctggcttcaggccctcaattatttccctttgagcttttttagaccctagatctcctaggcccaggctctctcttgaccccagagaagccactgtcaggaaaggaagtgaaccctactgaagccagagaattcaccccggccaaagcaggccctctgggtccagcccctcattccacacctgccgggcattgcaggatatccagtggggcctgtgactgctccctgatgcgtcagaagagaagtgttgcactttagtggaggagctgaggagcacctgcccccttgtagcttgagttccttttggtaacagtagcagcctccatggtggtgtctgggatgcacgtgcacccgctgccttcagctgtatgtgtgtgttcctgctggagttgtgttactgacaggataatgacattacaaagaaattgtgttatattcaactttgccttgataattattgtaaacactttgttcattttttcttttttattcacaaactaaatccaccaggaaattataaagttatttaaaaac

SEQ ID NO: 405062 - DNA, 2015 bp, Homo sapiens
  misc_feature (3)..(4): n is a, c, g, or t
ggnncaggaaaggctcctggtggaaggtgagacagagagagtcactgagagaacagggcaagaaggtggctggctgtgtgagggaacgaaaagtgcagtcgtacccttgtgaagctgagtggggccccatgggcctggccccacctgttgtccagagcatgcccctgcccccaggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405063 - DNA, 2456 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405064 - DNA, 2669 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaactttctcaagctttgctttggagccttgggtgagcccctggatgtggccatctcccccaagctgaggaggggttcctggagtgttcactgctaggggctgggcagatggctatgctcattctcgggccccatccaaaccgacaatctcccatgttcagttctctgcttactttgaaataatttaaaacttgcc

SEQ ID NO: 405065 - DNA, 2853 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaaaaaaaaaaaaaaaaaaaaaaaaaaaaaaaaaaaaaaaaaaaaaaaaaaaaaaaaaaaaaaaaaaaaaaaaaaaaaaaggggggggcaaattcccgggggggagcccaaaatactagcccaggccgcatgtttgatttttaaaaagggggcccccatataaggaggcatatattaatatcagagcggggcgggcgggcgcgcggtataaaaaaacaggtggtggagaggaaaaactgcgatgactgcggtcgaatctttgtgaggagaaaccacacccattcttggggggaggggagaaaataatgggagcaacaacacacctcagaggaaatataaaacagctggggagaaaaatataactcaagacgggattaaac

SEQ ID NO: 405066 - DNA, 1725 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcatgacgatgctgcctgtgtcaccctctaccatctgaggtatcgtcggggatcctcagg

SEQ ID NO: 405067 - DNA, 1900 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcggaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405068 - DNA, 1962 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagagccatgggccaggtggggctgcctcagtcctgtccccttgggcactgaggagaggggcccattcacctttctcctagaatgctgttgtaaataaacaaatggatccctggaaaaaaaaaaaaaaaaaaaaaaaaaaaaaaaaaaaaaaaaaaaaaaaaaaggggggggcaaattcccgggggggagcccaaaatactagcccaggccgcatgtttgatttttaaaaagggggcccccatataaggaggcatatattaatatcagagcggggcgggcgggcgcgcggtataaaaaaacaggtggtggagaggaaaaactgcgatgactgcggtcgaatctttgtgaggagaaaccacacccattcttggggggaggggagaaaataatgggagcaacaacacacctcagaggaaatataaaacagctggggagaaaaatataactcaagacgggattaaac

SEQ ID NO: 405069 - DNA, 1266 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagcccccttgggcactgaggagaggggcccattcacctttctcctagaatgctgttgtaaataaacaaatggatccctggaaa

SEQ ID NO: 405070 - DNA, 506 bp, Homo sapiens
tttggcaaaaacaaaaacaaacctggaagcctcaagacaatgaagtaaactttaggaagtggaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405071 - DNA, 2476 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405072 - DNA, 777 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtatgtggcccctacccttggggctgtggcctggggacaaggagcgtgtgtgggcagctcatcgggaggggtggctcacaggctgacgtgctgtctctgcatacctgtggttgctccctgacgtcaccaagcatcctctgtgctgggtccctgccaggaccc

SEQ ID NO: 405073 - DNA, 2650 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaaaaaaaaacacaaaacataacagcaagaaacacacaaagaacagcatcaaagagacaaagagaagggggcgcgcgcgcaacagaaacaccacgagagggggcaccaaatacaggaagagatccaccgatttttgcggaaaaacaggggggccacaatagagagcgcgcgataaca

SEQ ID NO: 405074 - DNA, 1677 bp, Homo sapiens
atcgctgctgctctcggtccagtggcttctccagcaccagctcagcgaatcggttgccatccccctgggtctgcacgtcaggcagaacgtagctgttgggggtgatctcgtactcgcgcaggactttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcagcctggttctcccggaggacctttccttggggccctgcttcatgacgatgctgcctgtgtcaccctctaccatctgtaaacaactgggtgccttccccgaccacaccccaatgccttcccagcttggaagccaaggcagctgatgaagggagctcaggagagccgtcttcagctgggctggggttggggctgctgtgaggaaaacctgccattgtggccctggagagtcaccagcagctcttgggaaggacttgctgggaggctgagagaggctttgggcacagcctgctgtcttttccatttcctaaagtttacttcattgtcttgaggcttccaggttttgtttttgtttttgccaaagtagaaaaggcaggtggtgggcggctggcagggagtgcgggtccccgcccctcttcagtcctgccctcccctcctcagtcctgcccaccccgtgcagcccatgctgaggctgcagtggtgtcgtgggtgttacgtgcaggaacgtggagaccctgacgtgggctcactgcgtttggttttcttttcagaacttgggagcccccagggaggggctagtgttggtaggtcctagacgtggttccctccagcctccccaaaatcaaccctggtgttgagagaacgtccttctgtccatcgtgggtaacagccttggggagggtgcagagctctgcagagccatgggccaggtggggctgcctcagtcctgtccccttgggcactgaggagaggggcccattcacctttctcctagaatgctgttgtaaataaacaaatggatccctggaaa

SEQ ID NO: 405075 - DNA, 2220 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagatccacattcaagtgtgcccaccctgcagtcttcatcctcactcagctgctgcctctggaggtgcctttggccacatgtgctgtgctgtttgtctcctcgacagggagcctgtccaccagcaggctgcggtcccagcgggtgcgtctgcagctcctccccttgggcggaagaaactggacagggtgctccgggaggatgccgagaaggggatccgcaagaagaacaaagggtgcgagacgtggacttctgcgtaacgcgatgtcgccagctgctaaccacggcgaggcggtcctcccagaagctgcaagaccagatgtcgacccataggactgggggagtgcacccaaagcaagtcattggtccaaggggacccaaggacgcatgcgacaagggccgctgaggcagcgatggtacgcgtggctggcaagggacgtgcccatacaagttgaatgagtacgagggtctcccgtaggcagagatgggtcgccagcaagccttcggtagcggtaccaggaactattgcgcgggggaaagggcatgggaagtaccagagggtaagcgtcgggaacaacccaatcgcctggacccaactgcccagcaagcgctgccagagtgggaacaagccatcgtcctatgcagggatccggccaggatggagaagatgtgcgtgggagggcgccagagtcccaaaaataacagcccaagcgggcgcgagggg

SEQ ID NO: 405076 - DNA, 1615 bp, Homo sapiens
agcgactcacaaaaggtcctcggccacggcgtgcgtcaccatggcgaccgccgccggcagccgcgccccgcccctctggcgggaccggccaccatcctctcgcgaggagcatcccgtgcgaccggaagtggggcggcgaccccggaagtccccgccgggtgcagcttggtcggttcgatcgccgccgggacctgacaccgcccggagttggcgtcccttctccctctccgagtgctgctcctgtcattgtggccatggacgataccctgttccagttgaagttcacggcgaagcagctggagaagctggccaagaaggcggagaaggactccaaggcggagcaggccaaagtgaagaaggcccttctgcagaaaaatgtagagtgtgcccgtgtgtatgccgagaacgccatccgcaagaagaacgaaggtgtgaactggcttcggatggcgtcccgcgtagacgcagtggcctccaaggtgcagacagctgtgactatgaagggggtgaccaagaatatggcccaggtgaccaaagccctggacaaggccctgagcaccatggacctgcagaaggtctcctcagtgatggacaggttcgagcagcaggtgcagaacctggacgtccatacatcggtgatggaggactccatgagctcggccaccaccctgaccacgccgcaggagcaggtggacagcctcatcatgcagatcgccgaggagaatggcctggaggtgctggaccagctcagccagctgcccgagggcgcctctgccgtgggcgagagctctgtgcgcagccaggaggaccagctgtcacggaggttggccgccttgaggaactagccgtgccccgccggtgtgcaccgcctctgccccgtgatgtgctggaaggctcctgtcctctccccaccgcgtcttgcctttgtgctgaccccgcggggctgcggccggcagccactctgcgtctctcacctgccaggcctgcgtggccttagggttgttcctgttcttttaggttgggcggtgggtctgtgtcctggtgttgagtttctgcaaatttctgggggtgatttctgtgactctgggcccacagcggggaggccaagaggggccctgtggactttcacccagcactgtgggggccttcagactctggggcagcagacatgctgcttcccatcagccagagggggtcagggctgccctgttgccaaacaactccctgaggcctctccgcaccacctcagcgggcaggaggtcccaccatgtggacagacatagcccaaggaggcaccacaggtctatgtgtgctgggggatgtcaggtgccacccaacgctgtcctggtggtatttacaatgacatcctcctcctccatcactccaggggtggtgtctcggccgcccctaccagctggctgagccccctggcctcctgcgctccctcacttccctcagttcccaaagctgcccagtccatggggacagaaccgtcactcagagccatgggccaggtggggctgcctcagtcctgtccccttgggcactgaggagaggggcccattcacctttctcctagaatgctgttgtaaataaacaaatggatccctggaaa

SEQ ID NO: 405077 - DNA, 240 bp, Homo sapiens
atccgccaatcctgggaaatgtgtaaaatcctgttcctgaaaaccggccgggttctcaaagtgtcccggctggcgtgttttgctagtcacgaaacatgatccatacgctgtattttaggactccccatctgtcggcatcggggagcgttttcccttgaggaagctcaaagcgtgtcagctcactgggaggggaggcagcagaagggtctgtgataacagagtggatccagagggctgggg

SEQ ID NO: 405078 - DNA, 321 bp, Homo sapiens
actccttcgacggtgtactgagcttaggtagggctcagctctaaccctgagtaaacatgacccagtttttttgttttttttgttgtttttttcctgaatacagaaacctgggttgacaggttttttttccctgttgggcactttataagatgttactctactgccttttaaacatctgtggtttctagtaagaagtaagctctaattataattgtcatttccctgtgtcattcttctctagctactttcttttcttttttctttttttttttttttttggaaagggtttcatccatttttccccccggggggcatagcatg

SEQ ID NO: 405079 - DNA, 206 bp, Homo sapiens
cctactgaaaggacagacatataaacaaataattaaaatatcatgtggggggggtttctgcttcccgtatatttgagaacagcatcaaacattcccatgaccattaaaaatctagataaggggcctggcatggtggttcatgcctgtaatcccagcattttgggaggccgaggcaggggatcacgaggtcaggagttcgagaccag

SEQ ID NO: 405080 - DNA, 376 bp, Homo sapiens
cacagccccctggttctgctggttttaacacactgtaaccaggtgcacctctgccatagattatctacattgataatggtctttccagaaagataactgaggaactcatatttagtcgttctgattcacatgtatcaacttgaactaaaggaggaccacatcattagaactaatggacagatcgaagatgaaaggaagaataaaggtctaggagctggtggacagtgtggctggagtatgtgtccagaatgggtttgccaggctccggccattctggactgtggagggacttgaaccccaaaggtgatggcaccccatggagagagctcatcctgcttggagaatgctatgaaagtaacgttccgggatcctctag

SEQ ID NO: 405081 - DNA, 210 bp, Homo sapiens
cagcattcagacacttgtaaattattttttgtgtgattttaaaacagcaaaatgacatttgagtgggaatgtttttcagttttaagggtgctcttccagaagagagactccatggttaacttcctcttgaagccatatgaaatgttcatggagtgctttgactctgcatttgtagccacatgaatgcaacagtgatactgccagtttaat

SEQ ID NO: 405082 - DNA, 428 bp, Homo sapiens
caccctgaccacatgggctccatgctgaaggctgctttacttctggacaggccttcacctgcatagaatggaagagacctggtggcacttgtcatggtgagacagtggctctcttctgagggagctccacagccaccatggatttaggtggacaaacagtggtatcctggtctgtggctagcatgggccccagagctgtgtgtgatgcatgtgttcctgatagcacaggggttctcagtgagggtggttctgcccctagggtatatttggtagtggctgaaaacagttttggttgtcactacttgggatggggttgctactggcatctcgtgggtggaggctgggatgctgctagctgtcctacactgcacaagacgaccccccatagaagacagtatctagccccagcatgaggggtaatgaggttg

SEQ ID NO: 405083 - DNA, 582 bp, Homo sapiens
atgttgctcaggacactatgtatgttgaacgttactgatgaagcaaagggtggcaaaaatatgctgctttttaagaagccaatgagcacctctgattgagaaacaggcttgcagaacacgtgggtgtcaccatagaaacaaatccttcaagatgatcagagcctttgagatagagtacccagtggatgggttttggaggaaagtgagagagagatcctcgctataggtggagtaaagatctaatttacacacccaactggatcatacaagcattccaaggctccttcagctgtgggttctttgtgtccttccattagcaatacaaatgagaagaaaatatttttgcaaagaagtgggaaagaatcctaggtcatgacagaggaaggtcacagagttcagacctggcaaaaccttccattcctactaagctatttcactgttattattcctcaaaactaagtgcaccgggcacagtggctcatgcctgtaatcccagcactttgggaggccaaggcaggtggatcacttgaggttaggagttcgagaccagcctggccaacaaggtgaaaccccatctccact

SEQ ID NO: 405084 - DNA, 413 bp, Homo sapiens
agcttgtgactatactgtaaagcaggcgtacggtcggaattccggatcgggagggagcgtcaaaaccaagggcaaacacggaaacggatcacactgtgaattaaccttggagagaaagtgttttaaaaagaagaatggaataactgagcagatgctaatcctagaatacataccgctttaattattccaggaagtttcacagaaaagccagttttatttaaaatgtactgctaattaccagggaatcatcaccctcctaccggctgaggttagcaccggaacatgaaatgtttctacttggacctaaagtgaggcagcccttgcctgtcctgtctgaggaaaacttcactctgccaattgcttttgtgtcctgaatctcctctcctctttaataaaccatattttttccccta

SEQ ID NO: 405085 - DNA, 321 bp, Homo sapiens
ttggttgttgtagaaatattcaaacatatacaaaagtagcaagagtaatgtaatgaatccccatttacctactacccagcctcaataatgattagtacatctctgtcccctttttaattggactattttaaagtaaatctcagatatactataatttcacctgtaagtacattggtacatatttcctttttttccttctcattttctcctttgaatttcaatatgtatttctaaagataaggactctttaaaaaaaaaagtcattattacaacctaaaaaaagaacagtattttttatgtcaccaaatatccagtcagtgt

SEQ ID NO: 405086 - DNA, 220 bp, Homo sapiens
ggggatgagaaataaatctattcctatcatatcatactgattatgttatactgactagcacagttctgggcacacattaatcacttcacagaaaacgtgctgactttaatatcatagtaggggatttgggttgtaacggagatggagaactttgtatatatgacttttccatctttacaatcttctttcactttgtagatgcattaaaaattgcctggct

SEQ ID NO: 405087 - DNA, 608 bp, Homo sapiens
ttgttagtgagctactggatatccatagtcactatcaaagagtaggcctctataaatagaagcagagatcaacaagtagatgaatggtaaagtatgaacagaaagtggaagaaccatttaaacatgtatttgtcccatagtaaatgctttatgtgtatttccttaccagctaatccttataacataaaaataaaaaattaatgctcatggaagttaagaaaactcagatcacacaggtagtaagtggcagattttacattcaaatcctggactgtctgattcctaagctcataatccacaaactcttcacctttcactacagcacaggaaaaatgtaagaaaagaaaaaaaaaaaaaaaaaaagggaagaaaagctagggagggagaaagttagaagaaaaaagatgatattgtcagagaaattaatctgtacccccatggttacaagtttggctgggtgtaaataatcttttaaaattataatttctacaggaaaaataaattgggttcccaaacaattcactttcccaaagaaacttgaacccaagaaattaagttgggaacttcgtatatatataacactttggatattttaaagtacttctata

SEQ ID NO: 405088 - DNA, 386 bp, Homo sapiens
gaaaaaaagcaaagccaaaatggaaaattggcatataatctgttatttggtggtgatgtgtgtccctaaattaccaaacatgtgataaagaaaacaacaaagaagaaaacctttagccttagctcagagaagcagctagaatatttcatcaactctccctttccctgccaacaaagaaaaatccaatttgggatgtaaccaaacttaaaaattgtatcataaaatttacttttaaaattcttttttgggatagagtgtcaaaaataaaaaagcaactgaaaagatgtggctgaaaagatgagtttgtaataaaagtaaatgcatgtcttcatgaaggacctgaatagcatttttctatcaaagaaaataaatatattaatactcag

SEQ ID NO: 405089 - DNA, 379 bp, Homo sapiens
ctaataaaatgcttcactcacacccagttgttttactcaagcgagtagttttatggtaactgcatttggggtaacagtcttacagaagagttaacacaatgggcagattccaggtgtgctgtcatttggaggaggcaaatccatacagacaagaagtagattagtggttgcctagagctggaggagggtagggataaggaatggattactactgggactgggtttctttttggggtgatgaaaattttctaaaattgattgtggtgatggttgcctaactctgtgaatagcaatgaattgtgctattgtacactttaggtaaatggtatggtatatgagttatatccccaataaagctgttaaaaaagaatgagaaaga

SEQ ID NO: 405090 - DNA, 860 bp, Homo sapiens
tccagtcacttcctggacctccaacctcagaccagacctgactcctctgtaacatgctctacaggtagctggtcctcttccttgcacttctcatggcatgtgagtgaagtctcctccaacttcaacactgggttcccagcgttggccatgtgggagatgcttgatgaatactggttggatgaatgaatgatttcaaccaagactcaatggcccagttattcttttctaagtgctcagatgaatccctcaggagaataaatatggcaccaagtattttagaaacatacatggtgctattctgtaatgaataattttacttcaatagactgtcagacctcttaactcatcttcctgactctaggctaacttcatgctgatctgactcaccctctcctaaactccccattgccccaggatagagtgagtcccagatcctgcagcctcttttccagcatgaccctccccggtggtgcagtggtgccccagcataccacatgtgcatgcttctgtggatctgaacctgactggaaggcccacacccctttctatcgagaaaattcctctttctgcagtcccagttctggagctagccatcaaggaggccttccttgcccattgctcagcttgcactcttggcctggcctctgactcttgtaccttttgtgtccttccattactacttacatcttcagtctgtcttagttgatggtgaacctgaggacggaagccatcgtggagtcgcctggcaggtcaacactcacacagcatctggaacacaggggccttcagcctggatgtgcttccattccataaggagttcctgcaaagcagggggtgtaagggcactatgatagtaaaaa

SEQ ID NO: 405091 - DNA, 1301 bp, Homo sapiens
tctgggatgatgcccaggctggtctcacagatcgaggggcactggctggtgatgggtgcccccaaaagacagagcagcgtcagaggagaggagagcacaggatgaggctgggagctcctgggtgactgggaaggggaggcaagaagaccatagggtccgtgcaccattcccagtccaggacgagtccttggatggatttaggtagattgattatcagagtcagatttgtgtttttggaaaaatcagcaccggattggaggctgatgcgacgcccgattagaggagggaggagagggggtgatggccaagtccagggtaggtggggatcctggaggaagccgtgccttggggatggggaggacactcagattcagagcacccaggggcccagtttcctatgaaatgggagcatgaagttgaagtgagggctgagcagaggggagcagacacgctcggggactgtctatgggcattaaaaatgtataaccattttagcaacaggcggcgagtcaaaaaacaaagtgtgtttatctaaactgggcaattccacttctaggaatttatcctaagggttggttgggggaataatcaaagctgtaaccaaatctttataacaagggtggttagctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtacagtggcgtggccacagctcactgcagcctcaacctccagggctcaaaagatcctccagcctcagcctcctgagtagctaggactacagatgcaggccactacacctggctaattttgattaggattattattagtttagagacagagcctcgctatattgctcaggcctgtctcaaattcctaagctcaagcaatctttctgcctcagtttcccacgtgctggaattacaggcgtgagccactgcacctgacccaactgtgtttttaaagtatatatgcattttcaaaaacctgtcagaaaatatagaaaaatgtcaatggtgtgtctggctggctgatgggatttcacctaattttaatgtggctttataattttctggttttgtgaagttgttcacaaaaagagacatttcttctaatataatttttaatacaacagtaatgtactcatgtgcattactctttttgtaatgagtatattacaaaatgtaatgacttttgtacattactcttttttcttgccaaaaaaaaa

SEQ ID NO: 405092 - DNA, 448 bp, Homo sapiens
aaagatttagactcccacacaataatagtgtgagattttaacaccccactcacaatactagacagatcatggaggcagaaaattaataaagttattcaggacctgaaccgagcactgaatcaaatagacctgatagacatctgcagaactctccaatgcaaaacaacataatacacattcttctcatcatcacatggcacatactctaaaatcagtcacataattggaagtaaaacactcctcagcattattagtgatgggagaaaactggaaaaaatccaaatatctaccagaaagggtgtgaaaaaacacaattgtatttgggggactgttgttgtttttgttttgaaacagtcttgatctgttgctcaggctggagtgagccatgattgtaccacttcactccagcctgggtaacagaggaagaccctgtctcaaaaaaaaaaaa

SEQ ID NO: 405093 - DNA, 147 bp, Homo sapiens
ctcatgtaactagagaaataagaagaatccaaacccacggcgaggaggagaaaagaaataaagaccagagcagaacaaaatagaattgaaataagcaaacaaacaaaatacaaaagataaatgaaacgaaaagctggttctttgaaa

SEQ ID NO: 405094 - DNA, 226 bp, Homo sapiens
ccaagatccttgggtgtgttttggggttgtccatacatcctctgaaagtgtcaacagcatttggggcatttgtctgagagtccatagagttcatcaaattctctctgatgctgaacagtaagaacagcagctttcaaataagtggtccaaagtcctactgtgcaacagtcacctgcagccatgcccacctaatggggactccttttattgggttctggggtttgcg

SEQ ID NO: 405095 - DNA, 183 bp, Homo sapiens
aaaaactttgccacagaaaaacaaaatattttttcccagttttgttttgtatttgaactaggagaaaatgtttcccttagggaaaaaattaggcaagtttcaaacaaaactagaaactgaatagatctaaagtatcagagtcttttgtgatctagatctcacagctgggatacatttgcagaa

SEQ ID NO: 405096 - DNA, 433 bp, Homo sapiens
aaaaattagctgggcatggtggtgcacgtgtgtagtcccagctactcaggaggctgaggcaggagaatcacttgaacccaggagacagaggctgcagtgagtcgagatcatgccactgcactgtagcctgggcgacagagtgagactccttcttgaaaaaaaaaaaaaaaaggaaaagaaaggagcctggcaaagaaagtaaagaaagtcagccctctcgatgaagggctgtgcacaggtgctgaatctggtaaatccctcgccctggtcccacagcaaccaaggcctccccttggtggcctgagtgccgccttctctcggggacgcctcttagccttcactggtgctgttctgcatgcctgaaacatccttctcctcttctcccatctccactctaagcgctccccacccttttctattcagccaggatccc

SEQ ID NO: 405097 - DNA, 514 bp, Homo sapiens
tcctggcttagccgggcacggtggcactccctgtagtcctggctactcaggaggctgaggcgggtggattgcttgagctcaggagttcaaggctacagtgagctgtgattatggcacgcactccagccagagcaacgaagtgagaatttatctctaaaagcaaaacaaaacaaaaaccctggaatatatcctaaaagaaaataaatgcagcgtatgggagaaagacacaccaggcggagagcatgagccaagactcaaaagtccggaaaacacgcagcatggtgagtgaatcacaagtagcacacacagctagaagacgctttcaaaccccgggatgatcggccccggtggggatgatttcagcagccaagagactattaacaggacttctacttctggccaagaagagtaacagtgatcagattgaccctcccatctaaaatacattttcttttaaacacaaaatatgtagaacagtggttttcaagacagtggacttcaggcaacaaaggag

SEQ ID NO: 405098 - DNA, 216 bp, Homo sapiens
gtgtggtgatacagcagtggatgagacagagaggtacatctatagagtctccatttatcagggaaaataaataaagacacacataaggtcatttctgataatgacaggtactcccatcacaggatgatgggcagtgggtcagggaacagacagtatctttagatcgggctgggaagatgagatgatgggcaagcttcatctgcaggatgaaaatgg

SEQ ID NO: 405099 - DNA, 270 bp, Homo sapiens
  misc_feature (197)..(197): n is a, c, g, or t
  misc_feature (206)..(206): n is a, c, g, or t
gttctaatagaagtaggaaatgaacacttcgtgggatgggtaaacagtgggagtcatggccaaaaatagtttagaatggatcatttactgcaatggttttcaagcacttttctttctttctttttttacagaatcagggtatcactcttgcccaggctggtaattttttatttttttagagacagagtcttgctatngtttcccanggctagccttgagactccatggaattcaagtgatccttccgtgcctcggacctcccaatagtac

SEQ ID NO: 405100 - DNA, 374 bp, Homo sapiens
aaccatcccatagtcctaaaataattactgcttctaatatagactgcacatgatttaattacttcacattgattttaaaacaaaacctacatgcaatagttgctgacagaagtttagacccgatgccttttcagccaggataggtacaagcactggcgcgtgtgacagcaggcttcaaacctcattcagcagacgggatagtaggctagataataaacagcaattagaactcactgtgataaaggccatggtaatattgttagagagtgctacagaaatgcacagtagtagttctctactcagaccaagagatcaggcagggcttcataaacatctccatgtaatttgccttacccgggctgttgcctaccctg

SEQ ID NO: 405101 - DNA, 299 bp, Homo sapiens
tcaggatacctagatgctcctccataacagggtcagtgagctggaatgttgaggactttcagcattgcaaggatcctccggtcacttaaggccattcagcctgatattgtcagtcttgcaatttcaggagcaaaaagtaaattccgtctttatctgttccaagaatgacacgagggccatggtcggtgattcagtagctgagacactactagtctcttccaggcccagagtaggaatttccttccgagcagcaacttgaatttgcataggattttccatgtcaccaccctgcaccttcc

SEQ ID NO: 405102 - DNA, 180 bp, Homo sapiens
tgaagaatgccaatatccttgtcacattccaggagaaattattgaataatttaatcaaaataacagataagcagaattcaaagaaactaatggcaaccacaaggtcagacacagaatctgtatagttcaacacagcaaagtaatagcaaatccatgtagaaaaatctctcataccaacaa

SEQ ID NO: 405103 - DNA, 300 bp, Homo sapiens
agccatcatttatgaagttaaaagcctaagtagtcatttagaattctttcatcactatggaaaatgggatggtttcctttagtcttggaaattcagctctcaaaagattatttcctcgcaggcacctggcttacaatcaggatgagctgcctgtgggtgatgatttgattttctttgaaatatggggaaaaggaggaaggattcaacttttgcaatttgtacagcctatcatcaggtgaagaaaacatttagcatttcaagattaaatttttatttgacttttccagtaatttatcacag

SEQ ID NO: 405104 - DNA, 295 bp, Homo sapiens
gcacttaaggcccagttcaggcacctggcttctgccatcttgaggcttgggcacccctagtggagtcctcttctggttcctcggcctgtggtgggtagaggaggaagagagagagtgaggaagatcatgctgcatgggtggggctcagcagcacagccacacccaaccacagggtgccacatgccacacaagagaaggaaatgggtttggtgaacactgagcagtctccacactggaaagagatgactgacgatccatgcaggcaattccatgtgctgtgggggagagatccaaa

SEQ ID NO: 405105 - DNA, 1343 bp, Homo sapiens
atgaccttcaaaccctgaagttaactaaaggttcatattttaaacttctgttgtttatctacacttatactttagctgacctcatcctgtctcatggttttatgtacagtactttttaacttactctcaaatttatatcaagtataacctcttccctgaactccagagtcatgtctaattgtctaatatcttcactttaatgaataatggtcatctcaaacttactgtatccaaagctaaaatcctgattttctgtcccaaaatggctccttccatacacttcccatcatatggggaagaaaaccccatgctacttgttcaggccacaaaccttagagttatccttactctcctctttcaccctacatccaatcccgtagcaaatcatgattataccttctatatataatcagaatcaaaccacgttttgccactgtcactgctaccatccattagtttgcaagataaactcatctctctcattttgttgcaataatttttgaactgttttctttgcttatacccttccgattttctggcatctctaccctttccattatactctccacaccgcagctaaggtcatcctttttgatgatgatgctttttaagagcaattatgtcactcttctgcttaaagaccccagtgactccccatctcacttacagtaaaagccataggccttatggtggcctgcaagaccctgcataatcattttgcctgctgcctttcttgtaattattgtgtcattggaacacaataatgcccattcatttatctgttgtctgtgtttgctttctctaaaatgtcaaagttgaatagttgtgacagaaactatatggcttgcaacacctggactatttcctatttgtcccttttcaggaaaagtttgctgaccccctgatctagagcataagattcttggtgacagggactcattttaatcgcagttgatttcatatcatttcaactgtgatttggcatctagtagattttttaaaattcttgaagggtggacagatctagatatatatgaatagggtgctagtttcttttctacttctactcctttttttctactagtttctactgcaaacttgctcccaagtaaatgcatgatgttacaacttctcagaagatgttcatggagcctaccacgctgctgaactgcccaatctgtggtcattctagtcttcatagacttgaaagctaagctatttccagtgataagactacctgaccaccttatgacaatggcaggtgaaagttgtagaaaatattggaatgttcctcttacggtgtaccaggagagcagagtgctgattaaatgtttcttttccta

SEQ ID NO: 405106 - DNA, 907 bp, Homo sapiens
tggtgaaaccccatctctacgaaaaatacaaaaattagctgggcgtggtggcacatgcctgtaatcccagttatcgggtaggctgaggcagaagaattgctggaacccaggaggcgaaggctgcagtgagctgagatcgcgccactgcactacagcctagtgtgacacagtgagactccaaaaaaaattgggtaaaaatagaatgtataactttcagccactagaagggggagaacaatttaaaaaataaatttcttggccatggctcatccctgtagtctcagcgctttggcaggactatcgcgtgaagccaggagttcaagactagcctgggcaacatacatagcaagacttcgtctctactaaataaaaaatagctgggcctggtaacaagtacccgtagtcccagttactggaaaggctgaggagggaggattgcttgatcccaggagttgcagatttctgtgagctatgatttcgccatgcactccagcctgggcagtagagcaagaccctgtctagaaaaaaaacaaagaaaagaaaacttccccaaaaggtacagaggtatgaagggaataaagaagtatgaagcatagaaaaaggcagggcaaataaaagcacaacataaaatgatagaaacaaattcaaatatatcaatcacagttaaacataaaagaataattttagcagttaaaagatagggatgatcagttcagattttttttaaaaatgtggctatatagagagacatatctaaaatagaaaagttaaaaggcagttactaaccaaaaacaataaaaaacataccgctatagtagctgcatgaataaagacgttaagacccaaaccaaaacattattaaagagggctgggtgcgatctcagctcacaatcactagtgaattcgc

SEQ ID NO: 405107 - DNA, 186 bp, Homo sapiens
aaagcccgttgttatatattctcatatttaatatgtgtaagatataaaataaaatgagcatccctgaaactatcacacagcttaagaattagagtattaacaatatcattgcatccacctgtatttttcttcctatattattcctttcctttcctttcgagataatcactattctgaactttgaat

SEQ ID NO: 405108 - DNA, 446 bp, Homo sapiens
gcagtctgtgaggagtgggccctcaccagacactgaatctgctggttggatttctcagccttcagaactatgagcgataaacttctgttgtttatgtttctgaatgagcacaggggatgagggaacagaaagaaggacaactcttaggtctctggcttgcttgactgggtagttagtggtgtcactgagtgagagagagagagagagtacagcaaaagatttagagaaaagtgaatgagttttaggcttattgattttaaggttatctgtggggcagccaggtggagaggtctcagacagtgttaatatgggtcaggagatacagattggggagacttccttatataggtgccaatagagtgcttggatatgacatagatacctgtctgtggtgagttatctcaactgctcttaggggctagctgagtgataaatgaagccatatg

SEQ ID NO: 405109 - DNA, 600 bp, Homo sapiens
aatgagactttttaattattctttcatgccctccttcagttcatgtttacacctgtaactactgcagtcccattatttttcttgatggaataggagaactcagcccagattcttatccacccagactatctctaggagaactacttggtgtcagccttgcaaataccattctcagaggtttcgtgtcatggggggagtagccgcctcagatgcacccagatcccaccaggtgtcgtgcgtagcaccccatgaagggagagcagccagggtgtgtggagccatgtccaaccatgagagggaaggctgctttttctactgttcccaatccttttctccatcttttgactttctgccaccaactatagatagacagagattgagacccccaaaacaaagttgatttattgcaaaataaatgtgtgatactctctcacattgcctgtttccttacctggttggcagtaggtcctcagaagtttgcgccgtggctgggcacacacctgtaatctgagcactttggcaggctgaggtgggagaatcacttaaggccaggagtttgacactggcctgagaaacatagcgagaccctgtctttacaaa

SEQ ID NO: 405110 - DNA, 310 bp, Homo sapiens
gaggcagagtctcactctgttgcccaggctggagggcaatggcacaatcttggctcactgcaacctctgctgcctgagttcaagtgattctcctgcctcagcctcctgagtagctgggattacaggcgcccaccaccatgcccagctaatttttgtatttttagtagagacagggtttaaccatgttggccaggctggtcttgaactcctgacctctggtgatccacccgcctttgcctcccaaagtgctaggattacaggcatgagccactgccggctgccccaatttcttaatttgtaaggtctaaac

SEQ ID NO: 405111 - DNA, 303 bp, Homo sapiens
ggtggtgaatgggggccactgtgagtgctggaaacctaagccggtaggtgggtggtggaagtgcagagtctgccctcttctgcccttcagcagtaactgaaaggggtgtcatttggaatgtcagagttggaaggagcctcagaattgattgggatccatcaatctcttaaagatgagaaagaaagaggaggtcgggcacaatggctcacgtctatgataccagcattttggaaggctgaggtgggaggattgcttgagcccaggagttccaaaccagcctgggcaaccctgtctctacaaatg

SEQ ID NO: 405112 - DNA, 560 bp, Homo sapiens
ctaagtgaaagaagtgaaacacagaaagccacattccgtatgactccatttatgtgagatatccagaatgagcaaatccatagagatagaaagcagattaatagttgctaggggctagggggaggggtaaatgggaagtgactacttaatggtacagggttgccatttggagtggtgagaaagttctggaaccagatagtggtggtggttgtacaatattgtgaatgtatttaataccactgaattgtacactttaaaattgttaaaatggcaaattttatgtgtattttactacaataaaaatggaaaataaactttatacatatattctgttcataatagcaattttaacttatcaaagaagaaaattttttaaattaaaaacatataatgagagaaatgtgagtcatttataattacaccattctgagaataactactgttaacattttggaatatttctttccattatcttttatatattatactaagactttttaaaattttttttccattctttatctgtctttgtatcaataaatctgaatatttggttacat

SEQ ID NO: 405113 - DNA, 370 bp, Homo sapiens
tgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcctgtcttggatgtgtgggtaattgtcagccacatgtgtgtgaagggctgtgcgtgtaggatttgtgcaaatgtgcccctccctgctgccagcccatgggaggctgtcaagattctgcc

SEQ ID NO: 405114 - DNA, 248 bp, Homo sapiens
gaggagatcaagaggtgaatgggagcccaggagctcagcacatagtaagtgctcaataaatatgtgatgaatgaatggacactcatctcccttagatgccccacataccatgttggcctctcttaccatgaacagcaacactcgtgactacagcatagagatattttttaaaccttacatttacactaactttcctgtgctttgttggggaagcatttttgaaccattcatatttattaattttcatg

SEQ ID NO: 405115 - DNA, 849 bp, Homo sapiens
caccaatgacgtaacaacaaaaaaaaagatgcttggaaactactgaaaaagtagaaagcttggtatctacagattcaaatctgggctccctgccctgctgtgaaaccctctgagcctcagtttcccacatgtcaagcagtataagaccctatggcagagagctgcagtgaggattaaggagacaagatcgtgggaagcacagggtaaaggctgcgtgcccctccccctctgccatcccccaacggaacagacacccagggtcccaggcggtacctgttatcacacagacaagagaaggaaagttgtgtccgtgaagattcagttgttcaaactctgtgtttaaaaaagaaacaattctacatggaatttctgatagattttttttttttctttctgacagactcttgctctgtcacctaggctggaatgcaatggtgtgatctcagctcactgcaacctctgcctcccgggttcaactaattctcgtgcatcagcctcccaagtagctgggattacaagcgcccaccaccatacctagctaatttttgtatttttagtaaagacagttttcaccatgttggccaggttggtctcgaactcctgacctcaggtgatctgcctgcctcagcctcccaaagttctaggattacaagtgtgagccaccatccccattcaaaaaaaaatttttgaataaacaatacccagagtcacctggtcaggtggagaaagtgcactgctctggcagggagtcccccagcctctgtgagatactctcctggagggggcatttcagcctgagagcctggtcactcaatgacccaaatggggattcagggaggcccaccttca

SEQ ID NO: 405116 - DNA, 242 bp, Homo sapiens
ccccttatatatcagtgccttatacaagctgggagaagagctctgaagctgcctacagttagcaggggctcaacaaaagacagtcaagtcatcctcatttacttttgatgtattgggtaggaatcctcaagccctggttttccaagcaaaaattttctttttttttttttttttaattagggaaactgtgctccgattctctcagaaggggtgcggggaccccgagcccgaaattcgataac

SEQ ID NO: 405117 - DNA, 404 bp, Homo sapiens
gaaaagggaggctaagcatggtggttcatgcctataatcccagcagtttcaggctggtctcaaactcttggcctaagtgatcctcctgcctccgaggtagcctgaggctagaaggatcacttgagcctaaggctaggaggatttttgagcctgagaggtcaaggctgcaggaggatcacttgatgccaagagtttgcgaccagcttaagcaacacattgagacccatctctacaaaaaataaaatataaaaaattagctgagtgtagtggtgtacacctttagtcccagctactcaggaggatgagacaggaggatcacttgagcccaggaggtcgaggccacagtgagccatcattgcaccgctgcactccagcctggtgacagtgagatccatctttaaaaa

SEQ ID NO: 405118 - DNA, 223 bp, Homo sapiens
gccactagtgtaggccactccttatttgtgttttccacaattttagaacactgctctgtatgtgataatcagtaaaggtttattgactcaaactgtttactgctttatgacaaatacttgtttcttcttcttcttttttttttttttttctttgaggtagggtctaagtctgctgcccagggtggagtgcagtggtgcagttgtagcttgctgcaacctcaaa

SEQ ID NO: 405119 - DNA, 1195 bp, Homo sapiens
  misc_feature (1160)..(1160): n is a, c, g, or t
  misc_feature (1168)..(1168): n is a, c, g, or t
  misc_feature (1170)..(1170): n is a, c, g, or t
caccagcactccggagaccccagaagacaggccacaccacacatgggccaggacaggaatctcctggtgccagggagagttatagggcagagatgcggcctggggtaggacaggagaccccagtgtgccttcctgagactgttatgtggtggccaccagtccccgagagatggaaaataggctgcttggcccagagatcggtcagctgcccactcgaaggctgtacctgctgcctttcctggcagggctggagggaggtggcttctgcagaggcgtgggggccacttctgcaccctctgggctgggaacccagcccccactagttcctcatatctgcggaagtgcctctaacactcttgcctgagtgagcggagcctggagaaggcccaggagggcagcagaccgaagaggccctatgcagaggtatcacctggtgactgggccggggagggggccaagggtggggtattgggctgtggggttgttgcacacagttgaattgctggtaggagctgtgtgtggtgggaaagggcagatctgaggtgtggccattgggtggggtggtaggtgtgtgtggccctgggagatgtgtggcccttgaggtagtgtgaggtgtgcatttgtaccgggccagtacggatgtggtttgtagacccaggcctggcagagctggctgtgtatgttcttggttcctgttggggagctccgaggagtttcctgaggtctggatgctggggtcgctgccctgcctgcctgtgctgggacagctgggcccagggtaggggatgaggctgtataagggaggtggtggtggacaagctgaggcctcagttaggacccctagcctgccttcctcccctccttgctccccatagggctaggtctttccttgaacccagggcagaggcctgtgcggaggggagctgaggatgcaatcaggggaggcggcctggccaagaggactccagagctgggtgtggaaagggttaggacctttaaggctgccctgatccagggctgactcatgcaaatcagaatgcaaaacaggctcagggaggcctcaagagagagccacacccacacggtcagcagactatgcaggtgacggagggccagccattgagcctttctctctaaacatcttctgttcccacccgtantggcccgnanatccgtactggcccgggggatcctc

SEQ ID NO: 405120 - DNA, 640 bp, Homo sapiens
tgagacagagtttctctttgtcgcctaggctggagtacagtggcatgatctcggctcactgcaacctccacttcccaggttcaagcaattctcatgcctcagcttcctgagtagctgggactacacgtacataccaccatgcctgactgattttttgtattttagtagagatggggtttcatcatgttgcctaggctggtctcaaactcctgagctcaggcagtctgcccacctcaacctcccaaagtgctaggattacaggtatgagccactgtgtctggccatatggaacacattctaatgtaactgtgaactaagagctagtagtccaacagatgttgagtattacggtttttccctaaaaaatttaaaatgtctcactacacccctttaaatttgctaggatgcctttgcacacagtttaggaaccacaatatgcatgcaattttgaattctgatttccttgcttgacatattataaattatcttctcttgtttttatatcgttataacaactgattttaatagctatataatattcactggagtcactgaatcataatcttaaccattcttcattttggacattttaggttatttgcaatctgatttttttaattaacaaataagaatcagtgaa

SEQ ID NO: 405121 - DNA, 1190 bp, Homo sapiens
ttgaaaatcactaaaaggggccgggcgcagtggctcacgcctgtaatcccagcactttgggaggctgaggtgggtggatcacaaggtcaggagttcaagaccagcctgaccaacatggtgaaaccccgtctctactaaaaatacaaaaattagccaggcttggtggcgtgcgcctgtaatcccagctattcagtaggctgaggcaggagaatctcttgaacccgggaggcggaggttgcagtgagctgaggtcgcgccactgcactccagtctgggtgacatagcgagactccatctcaaaaaaagaaagaaaattactaaaaggatgaaacgaatagaatctataatggaagaaaaagacgtaacaactaatgggtagatttaaaaacaactgagtaaaatttaaagcatggaaatagtcattgaaaggtattcatggattttttcaaatatttcagcatattgtcctgatttataattgtttataaaggaataagatggcttctactctgttgtctgcattagtaaggggagagcttcagtctagaaagtcttaatgacttcacactggatttgttttttacatttaatcataaataattgtacccttaagtccttgatcttatatgaagtcaatcaacaaagttcatttgactgaattctgcaagctactgtgtttgatatgtgattcatacaaaagcagtttgtcaacaaatatttattgaatatcaatatgagtcaggcacccacagtggcttaaaaaaaggaattctaaaatgatccttcgtacttatttattgtgaacttgtttatattctggaaaaattgaaagcaatttaaatatccatccataaaatatagtatattttgtatagtatatagatggataggctgatactaaagagagaatataagggccaggcacggtgcctcatgcctgtaatcccagcactttaggaggctgaggctggcggatcacttgaggtcaggagttggaaaccagctggccaatgcggtgaaaccccatctctactaaaatacaaaagttagtcgggcatggtggcagtgcctgtaatcccagctacttgggaggctgaggcaggagaattgcttgaacttgggagacagaggttgcagtgagccgagattgagccactacactccagtctgggtgacagagcaagactctg

SEQ ID NO: 405122 - DNA, 405 bp, Homo sapiens
cagtctctggctctccctgcctttcagcccagcctctctccacttccgtctctcctgtctaaggtcctcgttctgtttttccgtgtgcctcccactgtccttccatccccacgtcgcaccctcgctcctcggcttcccctgccgctctgcttcttccctaaagtcctcccgagaaagagtagggactctggagtttccgccgccgcgggcagaagggcaggaagagctccagggctgccccagctcctgagctcttggcggaagcttctgctccctcccggccctgctccgtgcgccggccgcccatcctccggcggcggctgcgaccccgacctcggcgggggaaaggaccgaaaagcaagagtgctggtgctctgctcgcccgcccaagcgtcaaggcgccca

SEQ ID NO: 405123 - DNA, 403 bp, Homo sapiens
tacaggcatgaaccaccatgcccaacctcatttacaatttttaaaaaaatcttaagatctgtattttttatagtttataaaagtttttttgtgatcacaaaaatacatgcttttggtagaaacacaaacatacaaagatgttctataaaactgactttttatcgtacattttaagatatttaaaaatattttctgtaatttcatgaagagtactaaagccacagtcactgacattgtaaacacctctgttcattctctaacctgttaggtggttaagctatttttaattctagggggctcaggctgaacttgaggttggggaggagaatttgcctctgcttttagttgcaattttcaagtgaggtgaaattaagtaaaatttgtaagagcttttttggctttt

SEQ ID NO: 405124 - DNA, 1677 bp, Homo sapiens
ccgggaagaagctcagcgcagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405125 - DNA, 293 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcactttaacatctgggaacctgcccaccagccttgttcctaataaaattaagttgtattcatttt

SEQ ID NO: 405126 - DNA, 2337 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405127 - DNA, 2251 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405128 - DNA, 2022 bp, Homo sapiens
  misc_feature (2)..(3): n is a, c, g, or t
  misc_feature (5)..(5): n is a, c, g, or t
  misc_feature (1951)..(1951): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttaccngattgaaccactgttcattatctttgagtacttataatccactggtagactggactggaccctgaattctt

SEQ ID NO: 405129 - DNA, 2088 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405130 - DNA, 2509 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacaccgtaagtgattccacatgatccctgggtgttgggggacaggggtcacttctacttcacacacacaggattgtcaggcctggactctgcctgtgtcactcactgcgttatgtcccatgctgggatttgggcatttagtgcaggacacacacagaggagacaaatttcaacagatcagaattcctttcctgcatccagaccctgcagacattaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405131 - DNA, 1572 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaaga

SEQ ID NO: 405132 - DNA, 1660 bp, Homo sapiens
gacccgatacgcggtcgatctgacgcggcttcgggaggagtcaggtgactgggtcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405133 - DNA, 1979 bp, Homo sapiens
gtgtgtgtgtgtgtgtgtttgtatgtgtgtgtgtgtctgtgttgtcaaggctgaggactgaagagaccttctcaggacccagggccccatgttttcacaccaatacataggtctcaatattgactgatgttctctccacctcctagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405134 - DNA, 1950 bp, Homo sapiens
gtatcttcagggttgcaggacaaagggaagtcccattattactcatctctagaatgtcctttgaaatggaagctgcagagaaatcacatctagggggacaaagtaggatggaatttggaaggggcccagcagttgcatattccaggtaaggaacccaaggtgagccagccagtcaactgattagggagggcctgggaagggtaccaggggctgtgactcccactgacgtgtctgtccatgacccaacactgctgctcaattgacacttcagaaagtctgtgcttccctaagacagagaaggcggcctcacagtctttgagcccttagatcatcatgcatctatcttgtgacaaaagcaccagctattggctttcaaggactcgggtggaatgagaggtgggagatgccaactctgattgaaggatacctgtggaggaatcaaaggtgccacacaggacaatcttctctctgttatccacacagcgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405135 - DNA, 2058 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405136 - DNA, 1744 bp, Homo sapiens
  misc_feature (2)..(3): n is a, c, g, or t
  misc_feature (5)..(5): n is a, c, g, or t
  misc_feature (1708)..(1708): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtccacacntatataaaaaatacacaacaatatagatagtagaga

SEQ ID NO: 405137 - DNA, 1572 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaaga

SEQ ID NO: 405138 - DNA, 851 bp, Homo sapiens
  misc_feature (2)..(3): n is a, c, g, or t
  misc_feature (5)..(5): n is a, c, g, or t
  misc_feature (842)..(842): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggcctagttttcttgtccttccttggcttacagattcatcaccgcaatctctgccttcatctttatacgcattctccctgtgncaagctaat

SEQ ID NO: 405139 - DNA, 1292 bp, Homo sapiens
ccaccggcaggttgtactccaccggcaggttgtactccaccggcaggttgtactccaccggcaggttgtactccaccggcaggttgtactccaccgcaggttgtatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405140 - DNA, 1462 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggacatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaaga

SEQ ID NO: 405141 - DNA, 2300 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacaccgcatgaagctgtacaggagatctctagaacctcctcatcctgcataactgaaaccggacacccacagaacaacgccctattcccctgatcccagctcctggcaaactactattctacactctgattcactctggaatccacgtgatatcaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405142 - DNA, 1075 bp, Homo sapiens
tcgaattcgatatatcatggtcgtaacataaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405143 - DNA, 2579 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacaccgcatgaagctgtacaggagatctctagaacctcctcatcctgcataactgaaaccggacacccacagaacaacgccctattcccctgatcccagctcctggcaaactactattctacactctgattcactctggaatccacgtgatatcaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405144 - DNA, 657 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaacctccatctccagcagcaactaaatcccatgtcacgctcgcgcggtaccgaca

SEQ ID NO: 405145 - DNA, 625 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactgcgccaggcactttcccagtcataccggttgtactaccacgcccctcgtatctagctcg

SEQ ID NO: 405146 - DNA, 1141 bp, Homo sapiens
  misc_feature (1070)..(1070): n is a, c, g, or t
gatcactttagttatcagactcctaccaacactgtaccaataacaaaaaatatggaaagctctttatccgccatattactacaaagcatagcgggctctatgtttgctctgttcgtaactcagccactggcaaggaaagctccaaatccatgacagtcgaagtctctggtaagtggatcccagcatcgttggcaatagggttttaggtggagtctatctggcattcagagaagagtcaggaaaacaattgtattcccagcctgtgtcccatgggcacaagcaaatcccaaattctcctcctgaaccctccaaatttgtctaagaacttcgaaaactttaacaaacaggctgatatcttcataatattcccagcctagaccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttaccngattgaaccactgttcattatctttgagtacttataatccactggtagactggactggaccctgaattctt

SEQ ID NO: 405147 - DNA, 1738 bp, Homo sapiens
ccgggaagaagctcagcgcagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405148 - DNA, 1712 bp, Homo sapiens
ccgggaagaagctcagcgcagaaggaggcaggacagcactgctgagagctgtgctcaggaagcttctggatcctaggctcatctccacagaggagaacacacagacagcagagaccatggggctcctctcagcccctccctgcacacagcgcatcacctggaaggggctcctgctcacaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctggtaagcggatcccagtatccttggcaatagggatttaggtggagtctatctggccttcagggaagagtcaggaaaacatttttattcccagcctgcgtcccatgggcacaagcaaatcccaaattctcctcctaaaccctccaaatttgtctaagaactttgaaaactttaacaaacaggctgatatcttcataaaattcccagcctagaccaagcaggaaaaacattgatttcaatgaaataattgataataatgaggataatgtttttatgattttcatttgaaaatttgctgattctttaaatggtttgttttctacattgacggaatttttctcttttaacctatctgtagcttatagcagttcaataaactata

SEQ ID NO: 405149 - DNA, 870 bp, Homo sapiens
cttaaccaagagtataaggggagtggacgctcttgtcatgggagacttggggcccacagcttgtgatgggagaaacaggtgaatacctgaggattcggctcagtgaacatagagggggttgggctgggacttgagggtgtgtcttggctcagagggtcactgtgtccctttaagagaccaggaacatccccttccctcagatgacatcacctgtggctttattctctttgctccagatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctggtaagcggatcccagtatccttggcaatagggatttaggtggagtctatctggccttcagggaagagtcaggaaaacatttttattcccagcctgcgtcccatgggcacaagcaaatcccaaattctcctcctaaaccctccaaatttgtctaagaactttgaaaactttaacaaacaggctgatatcttcataaaattcccagcctagaccaagcaggaaaaacattgatttcaatgaaataattgataataatgaggataatgtttttatgattttcatttgaaaatttgctgattctttaaatggtttgttttctacattgacggaatttttctcttttaacctatctgtagcttatagcagttcaataaactata

SEQ ID NO: 405150 - DNA, 2377 bp, Homo sapiens
  misc_feature (2)..(3): n is a, c, g, or t
  misc_feature (5)..(5): n is a, c, g, or t
  misc_feature (2306)..(2306): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctggtaagtggatcccagcatcgttggcaatagggttttaggtggagtctatctggcattcagagaagagtcaggaaaacaattgtattcccagcctgtgtcccatgggcacaagcaaatcccaaattctcctcctgaaccctccaaatttgtctaagaacttcgaaaactttaacaaacaggctgatatcttcataatattcccagcctagaccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttctgggaaccgtaattgaaacatttacttttgctttctacctgactgccccagaattgggcaactattcatgagaattgatatgtttatggtaatacacatatttgcacaagtacagtaacaatctgctttctttgtaacatgacacatttgaaatcattggttatattaccaatgctttgattcggatgttatattaaaaacatagatagaatgaaccaatatgaactgcaggcaaagtctgaagtcagccttggtttggcttcctattctcaagaggtttgtgaagatttaatctcagattccttataaaaacttagagaaaagaaaattttagaagacagcctacatggtccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgttaccngattgaaccactgttcattatctttgagtacttataatccactggtagactggactggaccctgaattctt

SEQ ID NO: 405151 - DNA, 284 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctccccccaccccccctgagcatacaagagggccga

SEQ ID NO: 405152 - DNA, 2045 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctggtaagtggatcccagcatcgttggcaatagggttttaggtggagtctatctggcattcagagaagagtcaggaaaacaattgtattcccagcctgtgtcccatgggcacaagcaaatcccaaattctcctcctgaaccctccaaatttgtctaagaacttcgaaaactttaacaaacaggctgatatcttcataatattcccagcctagaccaagcaggaagaacattgatttcattgaaataattgataataatgaagataatgtttttatgatttttatttgaaaatttgctgattctttaaatggtttgttttctacattgatggaatttttctcttttaatctatctacagcttatagcagttcaataaactatacttctgggaaccgtaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405153 - DNA, 1553 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtgggtcagaacataagggtgggtcagaacataaggggtaccgag

SEQ ID NO: 405154 - DNA, 2237 bp, Homo sapiens
ctgaccggtgtatatcgatgcacaaaacattctcctttctctgaaggtttacgatgcatgttatcattaaccagtcttttactactaaacctaaggtggccaactgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaactgtctgtctcatatcacgaacagcaaagcgacccaaaggtggatagtctgagaagctctcaacacacgcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405155 - DNA, 1321 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctacccagtgtcacgagaaatgaaacaggaccctatcaatgtgaaatacgggaccgatatggtggcatccgcagtaacccagtcaccc

SEQ ID NO: 405156 - DNA, 2058 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacgggaccgatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405157 - DNA, 827 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacctggagactcctaagccctccatctccagcagcaacttaaatcccagggagaccatggaggctgtgagcttaacctgtgaccctgagactccagacgcaagctacctgtggtggatgaatggtcagagcctccctatgactcacagcttgaagctgtccgaaaccaacaggaccctctttctattgggtgtcacaaagtatacatgacaactgggatcgctctagagtcaccgcgct

SEQ ID NO: 405158 - DNA, 1317 bp, Homo sapiens
ggtcctagcctcgcacagtggagcagcgtagttcttgagcagtgcgtcatggttgtgtgagttctgtgtcaaacttgctgtaggtctgctttgaggatctgcccagtccggcggctggcgtcttccagcatggtccagacctccccagaatttacccttcattcacctattaccgttcaggagaagtcctctacttgtcctgttctgcggactctaacccaccggcacagtattcttggacaattaatgaaaagtttcagctaccaggacaaaagctctttatccgccatattactacaaagcatagcgggctctatgtttgctctgttcgtaactcagccactggcaaggaaagctccaaatccatgacagtcgaagtctctgactggacagttccctgaattctactagtacctccaattccattttctcccatggaatcactaagagcaagacccactctgttccagaagccctataagctggaggtggacaactcaatgtaaatttcatgggaaaacccttgtacgtgaagcatgagccactcagaactcaccaaaatattcgacaccataacaacagatgctcaaactgtaaaccaggacaacaagtggatgacttcacactgtggacagtttttcccaagatgtcagaacaagactccccatcatgatgaggctctcccccctcttaactgtccttgctcatgcctgcctctttcacttggcaggataatgcagtcattagaatttcacatgtagtagcttctgagagtaacaacagagtgtcagatatgtcatctcaacctcaaacttttacataacatctcagggggaaatgtggctctctccaccttgcatacagggctcccaatagaaatgaacacagagatattgcctgtgtgtttgcagagaagatggtttgtatgaagacgtaggaaagctgaaattataatagagtcccctttaaatccacattgtgtggatggctcttgccgtttcctaagagatacattgtaaaacgtgacagtaagacattctagcagaataaaacatgtaccacctttgctaaaaaaaaaaaaaaaaaaaaaaaaaaaaaaaaaaaaaaaaaacaaaaaaaacaaaaaaaaaaaaaaaaaaaaaaaagagaggaggaagaaagaaaaaaacagggggagaaagcaacagaagaaaagagaaaaaaaacaacgagcagggagcaacgaaagaaaagagaaaaagagagagcaacgggcgaacaggaaacacacagagacaagagcgaggggaccacaaacaaaaaaaagcgggggaaaaa

SEQ ID NO: 405159 - DNA, 2274 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacaccgcatgaagctgtacaggagatctctagaacctcctcatcctgcataactgaaaccggacacccacagaacaacgccctattcccctgatcccagctcctggcaaactactattctacactctgattcactctggaatccacgtgatatcaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttaaacttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaataagggaccaatatggtggcatccgcagtgacccagtcaccctgaatgtcctctatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctggtaagcggatcccagtatccttggcaatagggatttaggtggagtctatctggccttcagggaagagtcaggaaaacatttttattcccagcctgcgtcccatgggcacaagcaaatcccaaattctcctcctaaaccctccaaatttgtctaagaactttgaaaactttaacaaacaggctgatatcttcataaaattcccagcctagaccaagcaggaaaaacattgatttcaatgaaataattgataataatgaggataatgtttttatgattttcatttgaaaatttgctgattctttaaatggtttgttttctacattgacggaatttttctcttttaacctatctgtagcttatagcagttcaataaactata

SEQ ID NO: 405160 - DNA, 923 bp, Homo sapiens
  misc_feature (2)..(3): n is a, c, g, or t
  misc_feature (5)..(5): n is a, c, g, or t
  misc_feature (788)..(788): n is a, c, g, or t
  misc_feature (813)..(813): n is a, c, g, or t
  misc_feature (835)..(835): n is a, c, g, or t
  misc_feature (857)..(857): n is a, c, g, or t
  misc_feature (891)..(891): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacacccgaagctgcccaagccctacatcaccatcaacaacttaaaccccagggagaataaggatgtcttaaacttcacctgtgaacctaagagtgagaactacacctacatttggtggctcttgtgaacagagacagttgagacttcaacatttcaaccccatagaaggcaaggaagtgcagccaggggaatggggaggcanggaagaaagcatgagtgtgcccggnagagcgatatgtgcatctcttnccaaacctctgagtcagtgcancagtgatgctggcagcatgacatgggacactgcnttggagaattacaccacagaagccgcccaatg

SEQ ID NO: 405161 - DNA, 2237 bp, Homo sapiens
agcggagagcagggaaaggtcagaaagggaagacccaggtctctgaaggaggcgtcaggaaagaagtctaaggatgccctgatgtgagcaggacctgagggcagtgtggagggggccgtgcggacccctggggaagaggattccaaacagaaaaatgccaagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatgggcctgcatatagtggacgagaaacagcatattccaatgcatccctgctgatccagaatgtcacccgggaggacgcaggatcctacaccttacacatcataaagggagatgatgggactagaggagtaactggacgtttcaccttcaccttacaccgcatgaagctgtacaggagatctctagaacctcctcatcctgcataactgaaaccggacacccacagaacaacgccctattcccctgatcccagctcctggcaaactactattctacactctgattcactctggaatccacgtgatatcaggtcattccttggactctgctctatctttagaggtcactggctcaagtcagccactatgagacacctgggaaaactgcgccaccttgtggctccactgcctgatgactgaactgacctccggacttgactctgttctcccctgtgttatttctgctgaagtacccagtcccaggccaggctttccagtacccaaagggtttaaagacaattggaagttccatcacccatctctaggatgtccttggcaagggaagctgcagagaaaacataccttgggcggcaaagtaagactgaaactaagaagattccagcactgcatgctccaagtgaggaccacaagtggagactcccaagccctccatctccagcagcaaattaaaccccagggaggccatggaggctgtgagcttaacctgtgatcctgagactccggacgcaagctacctgtggtggatgaatggtcagagcctccctatgtctcacaggttgcagttgtctgaaaccaacaggaccctctttctattgggtgtcacaaagtacactgcaggaccctatgaatgtgaaatacggaacccagtgagtgccagccgcagtgacccagtcaccctgaatctcctccatggtccagacctccccagaatttacccttcattcacctattaccgttcaggagaagtcctctacttgtcctgttctgcggactctaacccaccggcacagtattcttggacaattaatgggaagtttcagctatcaggacaaaagctctttatcccccaaattactacaaagcatagcgggctctatgcttgctctgttcgtaactcagccactggcaaggaaagctccaaatccatgacagtaaaagtctctgactggacattaccctgaattctactagttcctccaattccattttcttccatggaatcgctaagaaaaagacccactctgttccagaagccctataagctggaggtggacaactcaatgtaaatttcatgggaaaacccttgtacctgaagcgtgagccactcagaactcactaaaatgttcgacaccataacaacagatgctcaaactgtaaaccaggacaacaagtggatgacttcacactgtggacagtttttcccaagatgtcagaacaagactccccatcatgatgaggctctcacccctcttaactgtccttgctcatgcctgcctctttcacttggcaggataatgcagtcattagaatttcacatgtagtagcttctgagggtaacaatagagtgtcagatatgtcatctcaacccaaacttttacataacatctcagggggaaatgtggctctctccaccttgcatacaggactcccaatagaaatgaacacagagatattgcccgtgtgtttgcagataagatggtttctatgaagaggtaggaaagctgaaattataatagagtcccctttaaatgcacattctgtggatggtctcgccatttcctaagagatacattgtaaaatggacagtaatactgattctagcagaataaaacatgtaccacatttgca

SEQ ID NO: 405162 - DNA, 469 bp, Homo sapiens
  misc_feature (2)..(3): n is a, c, g, or t
  misc_feature (5)..(5): n is a, c, g, or t
gnntncgggctgaccctgcccatgagcttgagaattgctcctgccctgggaagaggctcagcacagaaagaggaaggacagcacagctgacagccgtgctcagagagtttctggatcctaggcttatctccacagaggagaacacacaagcagcagagaccatgggaaccctctcagcccctccctgcacacagcgcatcaaatggaaggggctcctgctcacagcatcacttttaaacttctggaacctgcccaccactgcccaagtcacgattgaagccgagccaaccaaagtttccgaggggaaggatgttcttctacttgtccacaatttgccccagaatcttaccggctacatctggtacaaagggcaaatgagggacctctaccattacattacatcatatgtagtagacggtgaaataattatatatggctgctctcctggcctctgctctccggtccggct

SEQ ID NO: 405163 - DNA, 1012 bp, Homo sapiens
ggtacctctgtatacgcggctcgatctgactacgcggctcgatctgctacgcggctcagcagcaacttataccccagggaggacatggaggctgtgagcttaacctgtgatcctgagactccggacgcaagctacctgtggtggatgaatggtcagagcctccctatgactcacagcttgcagttgtccaaaaacaaaaggaccctctttctatttggtgtcacaaagtacactgcaggaccctatgaatgtgaaatacggaacccagtgagtgccagccgcagtgacccagtcaccctgaatctcctcccgaagctgcccaagccctacatcaccatcaacaacttaaaccccagggagaataaggatgtcttagccttcacctgtgaacctaagagtgagaactacacctacatttggtggctaaatggtcagagcctcccggtcagtcccagggtaaagcgacccattgaaaacaggatcctcattctacccagtgtcacgagaaatgaaacaggaccctatcaatgtgaaatacaggaccgatatggtggcatccgcagttacccagtcaccctgaatgtcctctatggtccagacctccccagaatttacccttcattcacctattaccattcaggagaaaacctctacttgtcctgcttcgcggactctaacccaccagcagaatattcttggacaattaatgggaagtttcagctatcaggacaaaagctctttatcccccagattactacaaagcatagcgggctctatgcttgctctgttcgtaactcagccactggcatggaaagctccaaatccatgacagtcaaagtctctgctccttcaggaacaggacatcttcctggccttaatccattatagcagccgtgatgtcatttctgtatttcaggaagactggcagacagttgctttcattcttcctcaaagtatttaccatcagctacagtccaaaattgctttttgttcaaggagatttatgaaaaga

SEQ ID NO: 405164 - DNA, 299 bp, Homo sapiens
atcatgtaagtcagatcatgtcgctccttggctcaaaagccttctgtgacttcccatctcactcattaattccaaaatctctacgagccttcagggtcctatgtgacctggtcacccactccctgtgaattgatttcctatcctttgcttttcactcagttctttccagccacacaagactgctgtgtgtttcttatacatgccaagggtgcttttttttttttttttttcttataagacaggtctcactctgtgacctaggctgaagcggtggtgcaatcatggtacactgcagcctc

SEQ ID NO: 405165 - DNA, 1098 bp, Homo sapiens
  misc_feature (5)..(5): n is a, c, g, or t
  misc_feature (734)..(734): n is a, c, g, or t
ggccngctgacccatcgtgggatgcctgggcagtctccagactaaatgcctgtggctgtcagaacggaccaggctgtgtcctaaaactgtgcccacgggcctgcctcgcaggggaggtcttggctgtctctgccctccacagctgccctgcgcaccgcatgccctccactcgcgctgggtgccgagggccgggggagaaggcagggctgcctcgggaagggcgaccttggcccccccgtgtgaaacgcacacctgcatgaggctcccgcgctccctgctcccctcgcgtccttccctgggtgtctccgtgccaggtttttagggagtgcccccccaccccggcccccttctgtgttgctcctgccacttcagtcctctgggacacagggttgagtccgagcagcagagtattggtatgtctgtctgtcccgtggacctgccccgcagggcccagcgtttgtggctacgagcaccagcccgtctgcggcggaaaccccctgtgctcgacccgcttccggctcattcaggaatgtgtggcaactgcagacttgcatctggaacggggagacgtgaggttgcgactcctgcccccagacacactgccatggtgctgcccccagacgcactgctatggtgtggtcttagtgcccagtatctcgtttgagaggctcatccttgtcagaaacattaggcttagaatcgtttaagaagttgcaaattttctggccgggcanagtgctgggattaccggcgtgagccaccacgcctggccaaaagatttgttttttaacatatttgttataacttaagaatcccctctttggcttttgtttcctactccaaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagac

SEQ ID NO: 405166 - DNA, 468 bp, Homo sapiens
tgactgctgtccctggaggcatgagctcctcttccaggctgggctggcctgcagaaccagggactcccacattgaggaagttcctgagcaggcagcagactcccaaggagccaccccagcagctgtagctaaaaccaagggtgggcggaggagctgtgacataagacacccatcacccacccagccagcagcacacctgcattgagacctcgggtcctcgagtccctggcctggtgcattctccccgtgtcccccgagcttcagagcatcagcagtgttcctccttcactgtgacgcttgtcctcacttcccaggtgaggagtctaagaaaacagcctttccatcagcccctgtcgtgacagaccctccagtgggatggtagtggctgcctcacccatttacagggcaacccagttttgctccttctgccttgaaatttgttcctcccagaaactgtccctcacaagg

SEQ ID NO: 405167 - DNA, 317 bp, Homo sapiens
  misc_feature (269)..(269): n is a, c, g, or t
cttcacccctggctctcggcaatgctgctcctctctcctgcatggatcacctgctcctggaattcattctcccatttcttaggttgccactttactgtagcttcctaatcgaagagtcttgctgtgtcacccaggctggaatgccgtggcacaatctcggctcaacctccacctcctgggttcaagtgattcttctgtctcagcctcctgagtagctgggactacaggaagagtgcacaggagcctggcactcctggacctgaggaaancctgaaactgttggtatttgcagatcctcttccaaaaagagttcaccg

SEQ ID NO: 405168 - DNA, 493 bp, Homo sapiens
ttcattttatttaacttaagaacaacagaatgtagaatgtgtccagtcttgagctctgcttaagtgctatgccaatgaatacatgctcttactgataaattagatattatttgcaaagcagataaaagaataaacagtatcccagatgaagagaagaagctgagaagcagaaaatatgggaacatgaaagttctccacatattcagggaatgacacacttagtctgtgtcagagtggccagagtgtatgaatgtgtatgctgaagcagtgagagagagggctgtaaggtagagtcgggtcaaaaagagaaggtccatatatgcatcctaatgagtataatctcattatataagtaattgagagccactgggcatatataagtaggtaaatattttagaagaattctaatgatagtaagcaaagtggattgataggaggcaaggagatttattaagtggctattgcaatagacaagtaatggatttgtggaaca

SEQ ID NO: 405169 - DNA, 978 bp, Homo sapiens
gtgagacgtgtacgcttctgtttcaccttccgctgtgattctaagtttcctgaagccggctaccctgcttcctgttaagcctgtggaactctagtggacatctgaaaccctaaaacatctcatctgtgcaaaaaagaggaatgaccaggtcgggagagtgagaagctcgcaccacttcgaaagcgtctgcctggatgctgaagttcgggttgttcttgtagctctggatcacgcaggacttcacaccttgtcctccgcactcaatgagagcctgaggccgatccacagagaggagctgcaccttcttcatttcccgaactccccagaagagaacctgaggaaaagaccagcagagccatcaccacagatccacggaggagccccacacctgccctggctctgtgtggaaaagtcagacctgctccctgagaaccacgctgtgttcctccaggaaagaactgcacagctttttgagggctcattctttttctctaggtctcccgcccattccatatcacctctcctacaattcaggtggggccactgcccttgagtgccaaagaacaactcagctcctccgctgacccgtacctccactcggtatttgctcagcaccggccgaatgttggcaggaaccgggtagatctgggtgatgtctggtggctcaacgggtgggaggccttgcagcccagaagggggaacctaccgcacaaggcaagtatgagttagatgctggagagacacagggaaggcaacagtgccacacaaccacctcatcagtaagatgttcactgtttgcaccaaagtagttcaggtaaataagcagctttcctattatttttaatgtaagcgcttccaggtccccttgggcttaagtcccgcttacggccgtggggaaacacgaggttctttatcacccgggggctccccatgttcccctgtcaacgttaaagtggccgggaagaaagctacttcgac

SEQ ID NO: 405170 - DNA, 687 bp, Homo sapiens
aggaagggcctgagctgagcccttccctgagttcaacagagatgagagtctggggaagctgaggagactagaattcgtagggcaagaataccagaaagaatggagtcctggagagaaagagctacttatataaatctgcatggggctccttggagtcttgtggaataccaccctgcacatgtgtaggatgagactgcaagatactgggcagaaaataagaacagggagctgtgagctgcatggttcccagagctcacacagcaccgggaaccttcgagttctgcccagccacaatggagagaccttgcattgagtcaagagcccaggagggccgtgcctgagatgtatggctaaaagagctttttaggaaaggttactacagacctaccatgaccagggtgaaaaaacaagcctcagaagcatgaaggtgatccacaagcaacttaggagttgaaagaaaaagagagagagagagaggagggaggaaggaagggcggaaggaaaagaaaccagtactctttaaaggaagataacaaaatccagacactcaacaatgtgacattaaaaagttccatatccagtgaaaacagtcactagatatgttctagattttaaaagactaaaaagggctggaggccaggtgcagtgactcacacctataatcccagcactttgggaggctgaggt

SEQ ID NO: 405171 - DNA, 2385 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgagggaaaagtggaagctgtacttgggaattgtggagaagaccgccactccatctgatttgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtga

SEQ ID NO: 405172 - DNA, 721 bp, Homo sapiens
tggagctagaataactggtggagtcacagacatatttctagctccattaggtcaaaggaaaggaaagaggacaagggtagaaaggagacaagccctctaagaaactgtccattcagtctgtgactccaccagttattctaataatttgttttcttgaaaattgttaatttcaagactggagaaataaactcaccttctatttaaaaaaaaaaaaaaaaaaaaaaaaaaaaaaaaaaaaaaaaaaaaaaaaaaaaaaagaggggggggggggccaaagagatttccccggggggggccacacaacattatagcgcgcgccaacaccagcggaatttcttgggtgaacagagagggggccccccaataatgaggaggaggacatcatattaaacagcgagaggagacggggcgcgccgagcggataaacaacagcgctcgggacgaggggagaaaaaggcggcacagcggggggaaacttgtggggaaagaagaacccctatatctgggggagggggaaacaatatgtgggggaaagaggctcctccaaaaggggatttatgagcgcttaaagggggagaaattaaaaaattttaagaaggggttaaaggggtgggtaaaaaacgtggggataattagagtggggcggtaagaaaaagtttgtggcaaacaggaggtgttgttttattagaaaatattttatccggggagggttgtaaaaacg

SEQ ID NO: 405173 - DNA, 2054 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405174 - DNA, 1950 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405175 - DNA, 2330 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctatttactctgtgactttatgagaggttgaggtgcataaatgactcagtgggcttttgtatctcttcatttaagaattatttgaatgcctgccaggagccagatttgttctgggtattaggaatacactggttaacaggaccaaaaaagaccctgccctcactgagttttaaattttagtggagagatggaaaataattaaacaaataaacaatgttatagattgtga

SEQ ID NO: 405176 - DNA, 1499 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtcagtgagttgagctgcaacatttatgaaaggcatcctcttatatttttcatctcctgttacagtttttttctttttccaccctgaagtttttctcagtcgagttctccttatctcttctcataaccttgtgaaagtttctagagcagtggttctcagacttcattgagtatcacctgggaagtttgtgaaatatgatatc

SEQ ID NO: 405177 - DNA, 180 bp, Homo sapiens
gagatacagtggtccccatgagtacataggatgataggtggggctgatacatagtcacttccagttataggagaagggcttctcaaactgtctttctgagctggttaatggttactgcctaatccttccttgcctgctccttagtatgaccacaagcgaatctcaaagttgtcagagcgg

SEQ ID NO: 405178 - DNA, 2108 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405179 - DNA, 801 bp, Homo sapiens
  misc_feature (1)..(1): n is a, c, g, or t
ntgcctacactcataaccactacaactctagagtcaaggtcccccacaccgacatgcggccggcgcagtatctactatccccgcgctaccccctcttccgcaaagctatgtaggcacgccctccagagctcaagggaccgctaatagaagaatagcccccaccctctactgtatggcccctcaggcgttgttaaccgggcgatacaaagaaaccttgttacacctagtggatgctctagattggtatagaccagttgacttcagcatcagtccacctctatgacagaaacacaagaaaactgtctttccctagcttcagttccttgggtgtggagcactccccatttcttctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405180 - DNA, 1938 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggccctctcgggtcttaaagtgtgtggacattttcatcccgaagccatagagacatttgctgtcatattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405181 - DNA, 2047 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagggggtggcccgattctacaggtcacggaaaaagcacttgatcaccacccagacagaacacaaatgtgtcttggactcctgccgttcactggaagctgagggctttcaggtcacctacctcccagtgcagaagagtgggatcattgacctaaaggaactagaggctgctatccagccagatactagcctggtgtcagtcatgactgtgaacaatgagattggagtgaagcagcctattgcagaaatagggcggatttgcagttccagaaaggtatatttccatactgatgcagcccaggctgttggaaaaatcccacttgatgtcaatgacatgaaaattgatctcatgagcattagtggtcacaaaatctacggtcccaaaggggttggtgccatctacatccgtcgccggccccgtgtgcgtgtggaggccctgcagagtggaggggggcaggagcggggtatgcggtctgggacagtgcccacacccttagtggtggggctgggggctgcgtgtgaggtggcacagcaagagatggagtatgaccacaagcgaatctcaaagttgtcagagcggctgatacagaatataatgaagagccttccagatgtggtgatgaatggggaccctaagcaccattatcccggctgtatcaacctctcctttgcatatgtggaaggggaaagtctgctgatggcactgaaggacgttgccttatcctcagggagtgcctgcacctctgcatccctggagccctcttatgtgcttagagcaattggcactgatgaggatttagcgcactcttctatcaggtttggaattggccgcttcactacagaggaggaagtggactacacagtggagaaatgcattcagcatgtgaagcgtcttcgagaaatgagccctctctgggagatggttcaggatggcattgacctcaagagcatcaagtggacccaacactagaagaatagggccctgactttgtgctggtctggcccctcctgcctcaccaacccgtgcacaaccagacaccttgttacacctagtggatgctctagattggtatagaccagttgacttcagcatcagtccacctctatgacagaaacacaagaaaactgtctttccctagcttcagttccttgggtgtggagcactccccatttctattgctgctgggcacatctgtgctcttggtgaggagagcaagaggaaccagaagaagtctctttggtcagggaccatgatgctctacatggacatttgagtcttcgtcttctgctgctgctcggctggaccagcttctttaacagcaagcataatccacttcaatgtaatattttctgtagctccaaaggctatctcttcatattgactgcagacagactgaatggacagtttcttagagggcttgtctcctttctacccttgtcctctttcctttcctttgacctaatggagctagaaatatgtctgtgactccaccagttattctaataatttgttttcttgaaaattgttaatttcaagactggagaaataaactcaccttctattta

SEQ ID NO: 405182 - DNA, 797 bp, Homo sapiens
agcgccgggcaggacttccgggagcctggggcccaggactgcagcggcttcggaaggtgggctctgccagcgggaccatgctgctccgagccgcttggaggcgggcggcagtggcggtgacagcggctccagggccgaagcccgcggcgcccactcgggggctgcgcctgcgcgttggagaccgtgctcctcagtctgcggttcccgcagatacagccgctgccccggaggtggggccagtgctgcgacctctctatatggatgtgcaagctacaactcctctggacccccgggtgcttgatgccatgctcccttacctaatcaactactatgggaacccacactcccggacacatgcttatggctgggagagtgaggcagccatggaacgtgctcgtcagcaagtagcatctctgattggagctgatcctcgtgagatcatttttactagtggtgctactgaatccaacaacatagcaattaagactgagtctcactctgtcatccaggctggagtgcagtggcacgatcttgactcactgcaagctccgcctcctgggttcacgccattctcctgcctcagcctcctgagtagctgggactacaggcgccctccaccacacccggctaattttttgtatttttagtagagacaggggtttcactgtgttagccagaatggtctcgatctcctgacctcgtgatccgccctcctcggcctcccaaagtgccccacaaccatttttacttactgatgtaaatactttttaggataaaatagagtataaatcaattat

SEQ ID NO: 405183 - DNA, 4661 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405184 - DNA, 4754 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405185 - DNA, 2188 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttg

SEQ ID NO: 405186 - DNA, 740 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtggtaaggggtccgcagaataacgtgagaagcttggggatatcagtctctgccctggtctcatgagggacatggagccagcttgaggatgtatgcagtagaatacacagaaggatatagcacagtacatcctataggcattaggatctctgcttcaagaattgcacattttttattattaaaaattctttattataaaacttgttaatgtattataaaaattaaattataaattacatataaaatataaacttaacatttga

SEQ ID NO: 405187 - DNA, 465 bp, Homo sapiens
  misc_feature (4)..(4): n is a, c, g, or t
  misc_feature (26)..(26): n is a, c, g, or t
  misc_feature (84)..(84): n is a, c, g, or t
  misc_feature (105)..(105): n is a, c, g, or t
aacnagcctatgacccccatgaattnaacgccccaaagcctccgaaaattaaaccccctcacctaaagggaaacaaaaaagctnggagcctccccaccgcggtgncggccgcctcctagaacctaagtggatccccccgggctgccaggaattccggcacgaggttcacccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405188 - DNA, 492 bp, Homo sapiens
agtggggggatagaatatatttgagcctggagtcccctgtattaattttctttttcccaaatactgtgtccttagtccttcttcatcccccatgccccagcctgacctggctcttttctttcccagccccacaggtaggctggaagagtacctgggaagcatggccaagattcagaaggcagtggagtatttccaggacaacagcccagacagcccggaactcaacaaagtggtaaggggtccgcagaataacgtgagaagcttggggatatcagtctctgccctggtctcatgagggacatggagccagcttgaggatgtatgcagtagaatacacagaaggatatagcacagtacatcctataggcattaggatctctgcttcaagaattgcacattttttattattaaaaattctttattataaaacttgttaatgtattataaaaattaaattataaattacatataaaatataaacttaacatttga

SEQ ID NO: 405189 - DNA, 4823 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405190 - DNA, 5133 bp, Homo sapiens
gcccgggctcgcctcacctccccgcctgcttaagccctcccggagcgctcggggttcgacccccgagcacggcgggaggagggcgcccccctgcggcacagccacgtccacgaagcccctcccggggttctagaaagcggaggcctccgaaggaaagaccaagatgcagagagatgtctaaaaggtgccagaaggtgactatccagccctggtatcactgcctggtgatttcgtttctttgatcttcacgaatggcctcactggctgtgatttggacagaaatcagctgccacgtgcaacattctcccatgggaacatgtgtccgcagtacctatctcagagcccaaatccttcctgccccacagccttctcctgggacctgccttgggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405191 - DNA, 4957 bp, Homo sapiens
cttcagagagaacagaagttgagatttggcttcaaagggtggaagggaagccatcttgggctgattattttaagaagaattaatttgatgcttggtttgccttcaaataaaatttcaaccaatttgtcttagaccacctactatatgccaggcacatgataggtgctgaagatacagtggggaacaggtacaccctgttccttcgcttgtggagtttattgtctagaaaaccagagaaaaggcaggaaatgccgaaggtgggtgtgtagaagcagtgctgggaccactgtgagtcccaagatcaagaggcttccctcccgcaggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405192 - DNA, 3831 bp, Homo sapiens
tctagaggatccctgatgagaagagttgtgccatcccccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405193 - DNA, 4607 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaagggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405194 - DNA, 3496 bp, Homo sapiens
  misc_feature (3489)..(3489): n is a, c, g, or t
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctcccgtcgacgcggccgcgaatttagtagtagtagtagncggccgc

SEQ ID NO: 405195 - DNA, 3017 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggaagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405196 - DNA, 1628 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgacactcatgacgtctgttaacccacgagatgt

SEQ ID NO: 405197 - DNA, 1795 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtgagtgttctcccgggcagaccagcagccctgctgcctgcatgccctgcctttcccttccttctgtctgtgctctctggctattcccagggccctctcctaagtgccatctgatctttggaaccacaacctgacctctagttcagaggctgaggggagttgggctaa

SEQ ID NO: 405198 - DNA, 1319 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctttatctcgaggagataagcaggattcagagtttgagaagccccagtgtgcatcagacccagcacgttgaaatgtacccactacaaagaaaagaaactttttatctgaggaaggcgagccccctttaaatgatcaggcctagagaggcactggaatgagacaggtgtcacatttcactggccccactggagaaaga

SEQ ID NO: 405199 - DNA, 1272 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggacgatccgtaaggctcagaaccttctgaaacagtattcccagcatggtctagatgggaaaaaggggggctctaacctcattcctctggaaggtcacgagcatgatttccgagttaagcacctgtccgaggccttgaacgacaagcacgggccgctggccggtgagtaccgcagcccagcccgagggcagccgctgacactgccttcgcagcggtccccggatggcctgctcctgcctggcccagctgggcccactctgctctgaggatgggccaggcctatgcgcctctctctccactctctctcttttgggcctaggtctccttgcctctctccagatgggagtgcgtgcctgtctgtcaggcctgggccaaggggagaagccgctgctcctcggaaa

SEQ ID NO: 405200 - DNA, 752 bp, Homo sapiens
gcccgggctcgcctcacctccccgcctgcttaagccctcccggagcgctcggggttcgacccccgagcacggcgggaggagggcgcccccctgcggcacagccacgtccacgaagcccctcccggggttctagaaagcggaggcctccgaaggaaagaccaagatgcagagagatgtctaaaaggtgccagaaggtgactatccagccctggtatcactgcctggtgatttcgtttctttgatcttcacgaatggcctcactggctgtgatttggacagaaatcagctgccacgtgcaacattctcccatgggaacatgtgtccgcagtacctatctcagagcccaaatccttcctgccccacagccttctcctgggacctgccttgggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgcgaacctatgacctcgaacctatgacctgcgaacctatga

SEQ ID NO: 405201 - DNA, 979 bp, Homo sapiens
gcccgggctcgcctcacctccccgcctgcttaagccctcccggagcgctcggggttcgacccccgagcacggcgggaggagggcgcccccctgcggcacagccacgtccacgaagcccctcccggggttctagaaagcggaggcctccgaaggaaagaccaagatgcagagagatgtctaaaaggtgccagaaggtgactatccagccctggtatcactgcctggtgatttcgtttctttgatcttcacgaatggcctcactggctgtgatttggacagaaatcagctgccacgtgcaacattctcccatgggaacatgtgtccgcagtacctatctcagagcccaaatccttcctgccccacagccttctcctgggacctgccttgggaggcatccgctcgacggcgggagattgaggacaagctgaagcaggaggaggagactctgtccttcatccgagacagcctggagaagagcgaccagctcactaagaacatggtgagtctccccgcagctgggggagagggcaggcctccggaccctgggggagagccttgcgacctggcggttccggttcctgcggcctggagttctggaatgggcagcgacggaggcagtgtgtgggtttatctagcaacagtttggcatctctcctgcctagccccctccccatgttccgtaccctcactgaggaggctgcacttcccactggcctggacttgctgctttctgtctaagctcgccattcttccttctctccttctgcaaacactcagtgagtctgaccagttgggctaggtactgggcatatgtcattgtcagtggactctctgcccaggaggttggcactttgagattcctgagggcagagaagactcagccttcactccagaggactttagggaaagaaagagctctaaagtcaggcagatctgggatctagtccttgcccttctgcttaaatgtgcggctcctgat

SEQ ID NO: 405202 - DNA, 285 bp, Homo sapiens
aagcctgagtttgaccaggtgctccaggtatgtgggcgaggggccctcaaaaacacagccaggaggcatcgtgctgccgggtgtggccgccccatccctccctgggagaaccccattctctgtcccacacttctgctctgaaggtgcatggaagcagcttaggaagggccctgggtgagtgagatgctcacagagcgactggaggtgagctgggggctcccctgtgcttcctcagggcacggctgccagcacaaagaacaagctgcctggcctcatcacatccat

SEQ ID NO: 405203 - DNA, 439 bp, Homo sapiens
gacagggaatcgctcagggccaccccttccaagactatcaggagtgccttaggctgagggtggagctggggaggggtcggccctccctgtcccctgaccacagtgcctcctcaggtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctgggg

SEQ ID NO: 405204 - DNA, 874 bp, Homo sapiens
cttcagagagaacagaagttgagatttggcttcaaagggtggaagggaagccatcttgggctgattattttaagaagaattaatttgatgcttggtttgccttcaaataaaatttcaaccaatttgtcttagaccacctactatatgccaggcacatgataggtgctgaagatacagtggggaacaggtacaccctgttccttcgcttgtggagtttattgtctagaaaaccagagaaaaggcaggaaatgccgaaggtgggtgtgtagaagcagtgctgggaccactgtgagtcccaagatcaagaggcttccctcccgcaggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtggtaaggggtccgcagaataacgtgagaagcttggggatatcagtctctgccctggtctcatgagggacatggagccagcttgaggatgtatgcagtagaatacacagaaggatatagcacagtacatcctataggcattaggatctctgcttcaagaattgcacattttttattattaaaaattctttattataaaacttgttaatgtattataaaaattaaattataaattacatataaaatataaacttaacatttga

SEQ ID NO: 405205 - DNA, 2980 bp, Homo sapiens
  misc_feature (1530)..(1530): n is a, c, g, or t
  misc_feature (1823)..(1823): n is a, c, g, or t
  misc_feature (1933)..(1933): n is a, c, g, or t
  misc_feature (2055)..(2055): n is a, c, g, or t
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccaggtgagcccccatcctggcccatctctgcaacagccagaggctgactgggactgtactgctttagtccaatctagcgttcgcagcgtcaggcccctccagagcttgtcgttgtggtaaccccgactgtaggtacacaggacagaaagcaagtgtctacccacccagtgaggccccccaagagcaagactcttccttccagctagcagagcctggggttacacagcttctttggaataggggagtaacacaggtgctcagcgaatcccgcctgaggcagagcccctgcctaggcctcctccctcacacacacgtcgccctgtcagaaggccaggcacactactgcagccaggatgctgggatagcaaggggataggtgctccaaccttcaccttccagaaaggcagggtgatctgaagtgacgtgtagctgagagctggatggggagaatttcactttcccagttgatccagaaaggaaagaaaccccagagcatcctctcggaagaacttaaactggctttgggctccagtgcgagcgagtgacttgtggaaaggggcaccatgatgagaggccggggccggtgggtgttgctgtcctgggtgaacatctcgtcatctgtctgttctttctccccggcatcatatcccttatagtctgtnctccaggtaaacagtgtctctgccagccacagcttggcaagcccggctatgtctggccactgagagatgctgcccgcagctcgatgatgtgctgggatgttctggggtggggctgctgagattgcactgaaaaagaaagctggagaagccggggctgctcccacccaggctggccccctgtccagctgctgctgtgggcacatgccctagttgtggcctgtggcacctgcttatgacaacaagctttgggtagagcttacttacacccttggtttctccagtccctgcctgcncatgcccctcagagagtgaggtgtctgttccacaagagcacccgctcccctgcaggcctttgtttagggtttggagaaacaggcagagcaggggctgccctcagggagtngagcattagggagctggtgcctggggccttctccctccagtgtggaaatcctgcccaccagccaaaacctgctgcaaatggggactgccagcccagcctgtgggcgcagctgcctgcacagnggatggagcagctctgtgccttctgtgtggtggggagtggctgtctctatgaggctgctaggatgcttgggccccagccagtctgtgcttgcttcctcttctgcctggctccctgacaggtcccccagaagccccagagccctatttgcactgccttaagagtgcccgctggccatgcagctacctggcctttcaggcaggagggatctgatctcaggtggctcacagtggaccacatccatccttgggccagagacactagaggaaaactccagctgtggggtttcagagttgtcaggaactggtgggctcaggaccgatgtcaggctctagggagtcaggctctggggatgtcggttcccacttctgaggagagggacagggaggcctcccaggtggtgaagcaccgacctcagcatccctggaggcaattgggagcctgacgggtttggcggctgctagatccacatcggcgacccacatcctgccggcgtgcacctgcgtctgtgtctgctcctggtgggttgtggggcaggaatcagattcactcattagtaagccgcactcgctgaaggggagagcatgagcaaggcagacgtgagccaggccttggttattaggagctaattatgggccaagtatggtggctcacgcctgtaatcctagcacttcgggaggccgaggcgggcggatcacctgaggtcaggagttcgagaccagcctggccaacatggtgaaaccctgtctctactaaaaatagaaaaaaaattagttgggtgtggtgacgcacgcctataatcccagctacctgggaggctgaggcaggagaatcacttgaacccaggaggcagaggttgcagtgagccgaggtcgtgccaccgtactccagcctgggcgacagagtgagactgtctcaaaaaaaaaa

SEQ ID NO: 405206 - DNA, 372 bp, Homo sapiens
agcgtgtatttccgcgtgaagcaccgggagatgtagccatgctcgtccggccgcagcctcgtccgtcacgagcatgatttccgagttaagcacctgtccgaggccttgaacgacaagcacgggccgctggccggtgagtaccgcagcccagcccgagggcagccgctgacactgccttcgcagcggtccccggatggcctgctcctgcctggcccagctgggcccactctgctctgaggatgggccaggcctatgcgcctctctctccactctctctcttttgggcctaggtctccttgcctctctccagatgggagtgcgtgcctgtctgtcaggcctgggccaaggggagaagccgctgctcctcggaaa

SEQ ID NO: 405207 - DNA, 4730 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405208 - DNA, 4345 bp, Homo sapiens
atacgctaggtagcgaggctgggttgcgggcagtgacactgagaagatatcagagaggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405209 - DNA, 4013 bp, Homo sapiens
gcggccgcctactactactaaattcgcggccgctccatcaaaggactgaaggagcatttccataagagcagttcttcctctggggttccctactcccctgctatccccaacaagaggaaagacacacctaccaagaagccagtcaagcggccaggtcacgagcatgatttccgagttaagcacctgtccgaggccttgaacgacaagcacgggccgctggccgggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405210 - DNA, 3918 bp, Homo sapiens
cgggacaaggagcggcagattatcaaggagcgttttaagggcttcaatgatggcctcgaagaactgtgcaaaatccagaaggcctgggctattccagacacagagcagagggacaggattcgccaggctcagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405211 - DNA, 3617 bp, Homo sapiens
tacctaaacgtgggctatcttcaggctgttacgagtcctgaatccctggtattcacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405212 - DNA, 4366 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtctaggccgcctgccatggggtgcagcctctccaggggctgcgtcagacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcac

SEQ ID NO: 405213 - DNA, 4122 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacacttgcacgctgcccacatccagattcctgcaaagacgaattgggtgcacagcaccccaaccacatacacgaggaagaagatgcggtcagcagtctcaggccagcttctctgtgacccctttactcctctggagggctctgtggggagagatacagggaaaggagctgttcttcaaggtcccctcaacatgagcggaagagcgaaccccaggggtcatcagcctgtatcgcttcctttcttagattctcagctgatgaaaatttgggtctggcccatttcaggccatcttcagttgaagaaacaccctcttaggctgtgcaaggcatgggttatcaggggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405214 - DNA, 4278 bp, Homo sapiens
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgcctctgggctgggtgagcttgaagtcctctgggacagagacctgtctccacgcctccgggagctgtgtccctgagccccctagtcctggctcctgctttttccccacagcccgtgttcccagccgaaccagcactctcccggaagcctggggtccctccacaccttggcttttatgaccctgatggcttctgaaacaggaaaagagagaaggaagacagaggcctgtgcccactgctgctccatgtgtaccaagagcagcagggcagaagggccctccctccagcctaggtcagaggtggggacagagaactcccctacagcccagagatgtggcagggctcagagaagcagccagagctcctggaggaaaggcagtcgggactgaccccctctcttaaaacacattcccgcccgcccacaggcctgaggtctgggacctttccctcccaggagtcccctaggtggctgggggaggcaggctcactggccattttccctagagtccagcacactgcaggaggcgttcggaggaggagttccgccccaccctctacagccttcctcaggcccctgtctctggtccccagcctcagtgcctcttggcccagggccaggcagtcgtggttgcagaaggagcaattaggctgcctgcctgtgggctgggagacagggacaatggggaaaagttaaggagcaaaatgggggttggaagcaaaaaatagggccccacctatttaggacgagattgaagactgacccttgaggcacacttgcactggagatgggtttatttcacgctctgtgcttgtgtgctagcggagggagagctcagggtggcttaatccagaggccctgtcatggcccgcccccagccatgggaaagcaaacttcatcctaaggtgtgcagcccaggccctgcccctttacagtgggattgaggtcacctgggacttcagggaggctcagcttgctccctgccccagacctgtttcttctaagggaggaggacatggtggagaccagggacaggagagccagcagggtggatgcaaggggcctctacccacacctggacctccgtgccctcaccccagccctaggtgtgcacctaggcctcattccttaccccccagcccctgcccaccttcagcaggatgaggccctgggttgccgtgctctcgctgttcccctctcggggctgggctggggccgctcttggccccaaggttgccccgggccagcagcccagccagcagcacagtctctatggtgctgaggaagagcagcagcagcaggatggtgaagtagtaaactgggggaggcagggcacagggagatgctcaggggccagtccctgtgtctctggtgcccagcgagctgagcaccagtgggtgaccggggagaaacagggcagactgggtaagggagcagggcttactgagcagtgggttgcaggaggaggagctgggcagggcctgcaccagggaggagtggaggacgaggtaactcagcagcaatgtcaccttgtagcctatgcgctcaatggcccggaggggcagcaaccccccgcacacgtcagccaacagcagtgcctctgcaggcaccaagagagcgatgatggacttgagcgccgtgttcttcagcctcagctggaaggggaaaagtcagggccttcccggcgggggggaaggaggtgggcatcgggggcatggggcctggcctctggccgtgcatcctcactcccacccgcctccagcagccctctgtcggcctcctcgcgacttgactcaccgtcacctggaagcagggcaccagctgctggggtgggacttgggtcttcagatcataaactacgtattccctcttgacactcacaatctcgttcaccacgtgggcctggaactctaactccatcgctgaggggtgggaatgagaactatgaaccaggaaggagagatcccagctgccaagtctgggggtagcagactggagcccaggggtgatggagacttttgatggcttttggcagggacagacttggacacaaaaccgatccatagaagggcttcccaaaccttgttttgcaacatcccaaattgtctccagttgaaggaaggcctttatcagattcatagatgagctttcattgtaaaaataaatgtactttgcaccacttcaagat

SEQ ID NO: 405215 - DNA, 3202 bp, Homo sapiens
  misc_feature (3202)..(3202): n is a, c, g, or t
cgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgccttatgaagctggagaactccatcatccctgtgcacaagcagacggagaatctgcagcggctgcaggagaatgttgagaagacgctgtcctgcctggaccatgtcatcagctactaccatgtggccagtgacactgagaagatcatcagagagggccccacaggtaggctggaagagtacctgggaagcatggccaagattcagaaggcagtggagtatttccaggacaacagcccagacagcccggaactcaacaaagtgaaactgctctttgagcgcgggaaggaggccctggagtccgaatttcgcagcctgatgacgcggcacagtaaggtcgtctcgcccgtgctcatcttggatctgatcagtggtgacgatgatctggaggcccaggaggacgtgaccctggagcacctgcccgagagcgtgctccaggatgtcattcgcatctcccgctggctggtggaatatggccgcaaccaagatttcatgaacgtctactaccagatacgctccagccagctggaccgctccatcaaaggactgaaggagcatttccataagagcagttcttcctctggggttccctactcccctgctatccccaacaagaggaaagacacacctaccaagaagccagtcaagcggccagggagagatgacatgctggacgtggagaccgatgcctacatccactgcgtcagtgccttcgtcaagctggcgcagagcgagtaccagctgctggccgacatcatccccgagcaccaccagaagaagaccttcgactccctgatacaggatgccctggatgggctgatgcttgaaggggagaacatcgtgtctgctgcccggaaggccattgtgcgacacgacttctccacggtgctcaccgtcttccccatcctgcgacacctcaagcagaccaagcctgagtttgaccaggtgctccagggcacggctgccagcacaaagaacaagctgcctggcctcatcacatccatggagaccatcggtgccaaagcgctggaggacttcgcagacaacatcaagaatgacccggacaaggagtacaacatgccgaaggacggcaccgtacacgagctcaccagcaatgccatcctcttcctgcagcagcttttggacttccaggagacggcaggcgccatgctggcctcccaagagaccagctcttcggccaccagctacagctctgagttcagcaagcggctgctaagcacctatatctgtaaagtgctgggcaacctgcagttgaacttgctgagcaagtccaaggtgtacgaggacccagctctgagcgccatcttcctgcacaacaactacaattacatcctcaagtccctggagaagtctgaactgatccagctggtggcagtgacacagaagactgctgagcgctcctaccgggagcacattgagcagcagatccagacctaccagcgcagctggttaaaggtgactgattacatcgcagagaagaatctacctgtgttccagccgggagtcaagctccgggacaaggagcggcagattatcaaggagcgttttaagggcttcaatgatggcctcgaagaactgtgcaaaatccagaaggcctgggctattccagacacagagcagagggacaggattcgccaggcccagaagaccattgtcaaggagacctacggggcctttctacagaagtttggcagcgtgcccttcaccaagaacccggagaagtacatcaagtacggggtggagcaggtgggcgacatgatcgatcgccttttcgacacctctgcctgagcctgctgctagccctgcctggttccaccagactggcgtgtcattggacagataaaccagtgttagcttgaaaaaaaaaaaaaaaaaaaaaaaaaaaaaaaaaaaaaaaaaaaaaaaaaaaggggcgcgcgccgcccaaaaaatctctcccccggggaggccccagcagcgtgtctcccgcccacccacacacaattattgtgtgagaacaaagaggagggccccactaaaagggagagaggcagatataatatacagacatgacagagagggggcgcagccgggataaacacaacaagcagccaggaaagacaggaagaaaaaagcggcgaaaacaacgcgaggagagcacctatcggaggcgagagagaaccaccatataacggagcgggggcgcagcaacaaaacggggcgcaacaaacaccacccctcagagagaaaatataaaaaacaccacacgaggcagccacccaacaagacaactcgcgaacgagccgggcaaacacacccgcgccgggggaataaaaaccaagaaaaacgagagcaagcaaataaaacgccacacacgcggcggcaagcacagaacgagaaagaatcgggacggggacacacacgccgggagagtcaaaggcgatccagcggagagcacaacactttttctaacaaccaccgagggagggccgcagctcggagaaacaacgcggggtcgggcaagcatgcagcagcggaagcacgcgcagagcgaggggacgcacgcgacgaatgaaggggggaggtcaggagacgaggcgagaagggggggagggcagcaagcgggggaagggcggcggagagagaggaggagctaggcacgggacggacgggaagggcagcgaggagtcaacgccaaggagcagcagagagaacggcagacacgaggagagaaaggagaagcaagaagaaagagaagaaggacgaacagcgggggcaggccagagacgaaacaagacgccagacgatagaaagcgaaagggcaaggaaggaggagagaacaaaaagcaaaggagaaaagaaaaagaaaaggaccgagaacacaaaaagcgggagagagccagacgagagggacagaggggggcgcggagaagaaaacggcagaagaaagaagacacgaagacagccagaagagaagagacaaagn
